United States Patent 7,745,391 (HUMAN THROMBOSPONDIN POLYPEPTIDE) - sequence listing, part 95

SEQ ID NO: 304418 - DNA, 4777 bp, Homo sapiens
aggagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggacccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctgactggggcaaagaccaaccttccctgccatttatacggcataaaaccctcaatctcaccagtatggctaccaaaattataggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacacgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacaggtcagtcagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatca

SEQ ID NO: 304419 - DNA, 3627 bp, Homo sapiens
  misc_feature (11)..(11): n is a, c, g, or t
ctaaaattggnacgatacagagaagattagcatggcccctgcgcaaggatgacacgcaaattcgtgaagcgttccatattttaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacacgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacaggtcagtcagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatca

SEQ ID NO: 304420 - DNA, 3425 bp, Homo sapiens
aaatgaagacttatattgtatatttttcttccttgcccatgtgctgcaacacaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacacgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacaggtcagtcagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatca

SEQ ID NO: 304421 - DNA, 3503 bp, Homo sapiens
aggagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggacccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacacgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacaggtcagtcagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcattta

SEQ ID NO: 304422 - DNA, 2775 bp, Homo sapiens
ttatggttttgatttgcatttccctgatcactagtgatgtcaatcatcactgtcacttttaaaaggtactaatcccaaagcttttgatttgtttttaatttaggaaacaataaatatttagaccaaattgggaacacgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacaggtcagtcagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatca

SEQ ID NO: 304423 - DNA, 3449 bp, Homo sapiens
aggagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggacccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacacgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacaggtcagtcagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaataaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcattta

SEQ ID NO: 304424 - DNA, 2472 bp, Homo sapiens
ggcgactattgctgagtacagatgtgatcaaaggaagatagtatcagaaactgcaggatggactaattacactgaaattgctcatttatgtgaataggtgtcaagggtctcagagctgccatggagatggttcaaagttagagtataatcaaggcactctttagttggctggtaaaagttattctcccacagatatatgtatagagcttttcttaaattattatcagtgttaatagcagagtgtgacttttaaagaagaatcttgagctgcccaggtgaaagcctccattccattcttgttctgcatctaggtcagtcagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatca

SEQ ID NO: 304425 - DNA, 2672 bp, Homo sapiens
ctaagcatgtgtttgtgtgttataaaaggtaggctagcataactaggttgtgtgttgtgtatagctacagcaagacaagtattactgctgttttatattttaaaccttgatgctggtaacatgtgtttcttccttattgtgaaagggtgttacaagtggtatcagcaaaatcatttgcttttgaactctgaggtatttatatggcccctatgtgaagagtgctttggaaatggtttaagcccagtcaactctcttttatctgtcggtgggttctgagccttcctgctgcagctgtccagtcctttcctggatgctgacactgaggttggagaaagtcaaggctgggcatgtactggtggggggtgtgtgtatgtgtgtgtgtttttctctctctcatcaaattccaaagccaaatagaaatgatttctggaatcaccattgtaaaattgcccatgccttttctctcctccaaaacaaataatagagagttgagtgtaatttatttctattgtgagcagttcatttttactccatttttacaaataaagaattccagagacgagacactgagacttgcctagctttatcctaagagtgagtgacaggttactctttctacctcattgggccactttctgagtgatgactgctatgtatcccagatggcaatattcacgtttctgaatctaagcacttttctttcttttctccttgcccgatcagctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatca

SEQ ID NO: 304426 - DNA, 2397 bp, Homo sapiens
acgccattatagcccagaaaagagacaccaggaacagttgcaaaacaccccagtgtcacagcgtccaacccgagaatgtgcctggctcggcctcaggctcagagccctctgcaatgtggcagtccaagaacttggggcaggtcagtgaccatttctccatctttgcctcagctctccatccactcggtggcagtcccagagctgagcagctcgcagcttccgagcaatggctcttaccccgagcccccggccctgctacttccaaggcatataatatcactcggtctcttcaaatctcaatttccctgcctgtgaaatggggccgctgaatctcgatttccccgctgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatca

SEQ ID NO: 304427 - DNA, 2618 bp, Homo sapiens
ctaagcatgtgtttgtgtgttataaaaggtaggctagcataactaggttgtgtgttgtgtatagctacagcaagacaagtattactgctgttttatattttaaaccttgatgctggtaacatgtgtttcttccttattgtgaaagggtgttacaagtggtatcagcaaaatcatttgcttttgaactctgaggtatttatatggcccctatgtgaagagtgctttggaaatggtttaagcccagtcaactctcttttatctgtcggtgggttctgagccttcctgctgcagctgtccagtcctttcctggatgctgacactgaggttggagaaagtcaaggctgggcatgtactggtggggggtgtgtgtatgtgtgtgtgtttttctctctctcatcaaattccaaagccaaatagaaatgatttctggaatcaccattgtaaaattgcccatgccttttctctcctcctttactccatttttacaaataaagaattccagagacgagacactgagacttgcctagctttatcctaagagtgagtgacaggttactctttctacctcattgggccactttctgagtgatgactgctatgtatcccagatggcaatattcacgtttctgaatctaagcacttttctttcttttctccttgcccgatcagctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatca

SEQ ID NO: 304428 - DNA, 1883 bp, Homo sapiens
aaaataaaaaaaaaataaaaaaaaaaaaaaaaaaaaaaaaaaaaaaaaaaaaaaaaaaaaaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatca

SEQ ID NO: 304429 - DNA, 2462 bp, Homo sapiens
aggagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggacccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacacgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgccgagccatggaaccatgggaagaccttcacttgcactgctgcctaccccgagtccaaaccccgggaagtttcca

SEQ ID NO: 304430 - DNA, 1901 bp, Homo sapiens
aggagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggacccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagaccacaggacggggtcgacgcggccgcgaatttagtagt

SEQ ID NO: 304431 - DNA, 1672 bp, Homo sapiens
aggagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggacccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctgactggggcaaagaccaaccttccctgccatttatacggcataaaaccctcaatctcaccagtatggctaccaaaattataggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggtaaaccacaaagctaacaattcatgcactttcatggaattgttctccctctccactcttcctcatggtctgtggtgctgggcactgagcctcttcaatttgtctgtcattatgaccaagcgacataacccatttccattctttccctagggtcatcaggcttttcttacagttcatgggtctacctctgtggtaatgggtctttgtgtgtcctttgtatacctctaaacattttacttttttttttttaactttgtaaaaaaaaa

SEQ ID NO: 304432 - DNA, 1683 bp, Homo sapiens
aggagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggacccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctgactggggcaaagaccaaccttccctgccatttatacggcataaaaccctcaatctcaccagtatggctaccaaaattataggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatattcacacgtgagccagggcagaactgagggaagagtggccacaggcacacaaggcggcgaaaggagagattccacgtactttggtcgaggaacgttgagctagccaaccgctgtctcgaccacgaggccttttgcgcctgcaagcaacggagacggccatgaaaaaaataacgaacagaaagaggcacacaagaa

SEQ ID NO: 304433 - DNA, 1574 bp, Homo sapiens
gaacttttcattcataaaaagaaaagactccgcacggcgcgggtgagtcagaacccagcagccgtgtaccccgcagagccgccagccccgggcatgttccgagacttcggggaacccggcccgagctccgggaacggcggcgggtacggcggccccgcgcagcccccggccgcagcgcaggcagcccagcagaagttccacctggtgccaagcatcaacaccatgagtggcagtcaggagctgcagtggatggtacagcctcatttcctggggcccagcagttaccccaggcctctgacctaccctcagtacagccccccacaaccccggccaggagtcatccgggccctggggccgcctccaggggtacgtcgaaggccttgtgaacagatcagcccggaggaagaggagcgccgccgagtaaggcgcgagcggaacaagctggctgcggccaagtgcaggaaccggaggaaggaactgaccgacttcctgcaggcggagactgacaaactggaagatgagaaatctgggctgcagcgagagattgaggagctgcagaagcagaaggagcgcctagagctggtgctggaagcccaccgacccatctgcaaaatcccggaaggagccaaggagggggacacaggcagtaccagtggcaccagcagcccaccagccccctgccgccctgtaccttgtatctccctttccccagggcctgtgcttgaacctgaggcactgcacacccccacactcatgaccacaccctccctaactcctttcacccccagcctggtcttcacctaccccagcactcctgagccttgtgcctcagctcatcgcaagagtagcagcagcagcggagacccatcctctgacccccttggctctccaaccctcctcgctttgtgaggcgcctgagccctactccctgcagatgccaccctagccaatgtctcctccccttcccccaccggtccagctggcctggacagtatcccacatccaactccagcaacttcttctccatccctctaatgagactgaccatattgtgcttcacagtagagccagcttggggccaccaaagctgcccactgtttctcttgagctggcctctctagcacaatttgcactaaatcagagacaaaatatttcccatttgtgccagaggaatcctggcagcccagagactttgtagatccttagaggtcctctggagccctaaccccttccagatcactgccacactctccatcaccctcttcctgtgatccacccaaccctatctcctgacagaaggtgccactttacccacctagaacactaactcaccagccccactgccagcagcagcaggtgattggaccaggccattctgccgccccctcctgaaccgcacagctcaggaggcgcccttggcttctgtgatgagctgatctgcggatctcagctttgagaagccttcagctccagggaatccaagcctccacagcgagggcagctgctatttattttcctaaagagagtatttttatacaaacctaccaaaatggaataaaaggcttgaagctgtg

SEQ ID NO: 304434 - DNA, 1665 bp, Homo sapiens
gaacttttcattcataaaaagaaaagactccgcacggcgcgggtgagtcagaacccagcagccgtgtaccccgcagagccgccagccccgggcatgttccgagacttcggggaacccggcccgagctccgggaacggcggcgggtacggcggccccgcgcagcccccggccgcagcgcaggcagcccagcagaagttccacctggtgccaagcatcaacaccatgagtggcagtcaggagctgcagtggatggtacagcctcatttcctggggcccagcagttaccccaggcctctgacctaccctcagtacagccccccacaaccccggccaggagtcatccgggccctggggccgcctccaggggtacgtcgaaggccttgtgaacagatcagcccggaggaagaggagcgccgccgagtaaggcgcgagcggaacaagctggctgcggccaagtgcaggaaccggaggaaggaactgaccgacttcctgcaggcggagactgacaaactggaagatgagaaatctgggctgcagcgagagattgaggagctgcagaagcagaaggagcgcctagagctggtgctggaagcccaccgacccatctgcaaaatcccggaaggagccaaggagggggacacaggcagtaccagtggcaccagcagcccaccagccccctgccgccctgtaccttgtatctccctttccccagggcctgtgcttgaacctgaggcactgcacacccccacactcatgaccacaccctccctaactcctttcacccccagcctggtcttcacctaccccagcactcctgagccttgtgcctcagctcatcgcaagagtagcagcagcagcggagacccatcctctgacccccttggctctccaaccctcctcgctttgtgaggcgcctgagccctactccctgcagatgccaccctagccaatgtctcctccccttcccccaccggtccagctggcctggacagtatcccacatccaactccagcaacttcttctccatccctctaatgagactgaccatattgtgcttcacagtagagccagcttggggccaccaaagctgcccactgtttctcttgagctggcctctctagcacaatttgcactaaatcagagacaaaatatttcccatttgtgccagaggaatcctggcagcccagagactttgtagatccttagaggtcctctggagccctaaccccttccagatcactgccacactctccatcaccctcttcctgtgatccacccaaccctatctcctgacagaaggtgccactttacccacctagaacactaactcaccagccccactgccagcagcagcaggtgattggaccaggccattctgccgccccctcctgaaccgcacagctcaggaggcgcccttggcttctgtgatgagctgatctgcggatctcagctttgagaagccttcagctccagggaatccaagcctccacagcgagggcagctgctatttattttcctaaagagagtatttttatacaaacctaccaaaatggaataaaaggcttgaagctgtggcctgagtgcctcactggacccagaggccaatgggagagtatttggagccctaggtcccagccttagctctacagactcactgcatgacct

SEQ ID NO: 304435 - DNA, 1578 bp, Homo sapiens
cccgggctgccccaaagccacacagcttatgagcagggatttgccaccaggtcagtctctgactgccaagctgtgctctttctgttcccagagctagcctgtacattgaaggtagacagcagtgtagcctctgcccagtggaagcccctcaatccacacggacctcatctgtggccttccatttcttattccttagaagttccacctggtgccaagcatcaacaccatgagtggcagtcaggagctgcagtggatggtacagcctcatttcctggggcccagcagttaccccaggcctctgacctaccctcagtacagccccccacaaccccggccaggagtcatccgggccctggggccgcctccaggggtacgtcgaaggccttgtgaacagatcagcccggaggaagaggagcgccgccgagtaaggcgcgagcggaacaagctggctgcggccaagtgcaggaaccggaggaaggaactgaccgacttcctgcaggcggagactgacaaactggaagatgagaaatctgggctgcagcgagagattgaggagctgcagaagcagaaggagcgcctagagctggtgctggaagcccaccgacccatctgcaaaatcccggaaggagccaaggagggggacacaggcagtaccagtggcaccagcagcccaccagccccctgccgccctgtaccttgtatctccctttccccagggcctgtgcttgaacctgaggcactgcacacccccacactcatgaccacaccctccctaactcctttcacccccagcctggtcttcacctaccccagcactcctgagccttgtgcctcagctcatcgcaagagtagcagcagcagcggagacccatcctctgacccccttggctctccaaccctcctcgctttgtgaggcgcctgagccctactccctgcagatgccaccctagccaatgtctcctccccttcccccaccggtccagctggcctggacagtatcccacatccaactccagcaacttcttctccatccctctaatgagactgaccatattgtgcttcacagtagagccagcttggggccaccaaagctgcccactgtttctcttgagctggcctctctagcacaatttgcactaaatcagagacaaaatatttcccatttgtgccagaggaatcctggcagcccagagactttgtagatccttagaggtcctctggagccctaaccccttccagatcactgccacactctccatcaccctcttcctgtgatccacccaaccctatctcctgacagaaggtgccactttacccacctagaacactaactcaccagccccactgccagcagcagcaggtgattggaccaggccattctgccgccccctcctgaaccgcacagctcaggaggcgcccttggcttctgtgatgagctgatctgcggatctcagctttgagaagccttcagctccagggaatccaagcctccacagcgagggcagctgctatttattttcctaaagagagtatttttatacaaacctaccaaaatggaataaaaggcttgaagctgtg

SEQ ID NO: 304436 - DNA, 1466 bp, Homo sapiens
gaacttttcattcataaaaagaaaagactccgcacggcgcgggtgagtcagaacccagcagccgtgtaccccgcagagccgccagccccgggcatgttccgagacttcggggaacccggcccgagctccgggaacggcggcgggtacggcggccccgcgcagcccccggccgcagcgcaggcagcccagcagaagttccacctggtgccaagcatcaacaccatgagtggcagtcaggagctgcagtggatggtacagcctcatttcctggggcccagcagttaccccaggcctctgacctaccctcagtacagccccccacaaccccggccaggagtcatccgggccctggggccgcctccaggggtacgtcgaaggccttgtgaacaggagactgacaaactggaagatgagaaatctgggctgcagcgagagattgaggagctgcagaagcagaaggagcgcctagagctggtgctggaagcccaccgacccatctgcaaaatcccggaaggagccaaggagggggacacaggcagtaccagtggcaccagcagcccaccagccccctgccgccctgtaccttgtatctccctttccccagggcctgtgcttgaacctgaggcactgcacacccccacactcatgaccacaccctccctaactcctttcacccccagcctggtcttcacctaccccagcactcctgagccttgtgcctcagctcatcgcaagagtagcagcagcagcggagacccatcctctgacccccttggctctccaaccctcctcgctttgtgaggcgcctgagccctactccctgcagatgccaccctagccaatgtctcctccccttcccccaccggtccagctggcctggacagtatcccacatccaactccagcaacttcttctccatccctctaatgagactgaccatattgtgcttcacagtagagccagcttggggccaccaaagctgcccactgtttctcttgagctggcctctctagcacaatttgcactaaatcagagacaaaatatttcccatttgtgccagaggaatcctggcagcccagagactttgtagatccttagaggtcctctggagccctaaccccttccagatcactgccacactctccatcaccctcttcctgtgatccacccaaccctatctcctgacagaaggtgccactttacccacctagaacactaactcaccagccccactgccagcagcagcaggtgattggaccaggccattctgccgccccctcctgaaccgcacagctcaggaggcgcccttggcttctgtgatgagctgatctgcggatctcagctttgagaagccttcagctccagggaatccaagcctccacagcgagggcagctgctatttattttcctaaagagagtatttttatacaaacctaccaaaatggaataaaaggcttgaagctgtg

SEQ ID NO: 304437 - DNA, 1065 bp, Homo sapiens
gaacttttcattcataaaaagaaaagactccgcacggcgcgggtgagtcagaacccagcagccgtgtaccccgcagagccgccagccccgggcatgttccgagacttcggggaacccggcccgagctccgggaacggcggcgggtacggcggccccgcgcagcccccggccgcagcgcaggcagcccagcagaagttccacctggtgccaagcatcaacaccatgagtggcagtcaggagctgcagtggatggtacagcctcatttcctggggcccagcagttaccccaggcctctgacctaccctcagtacagccccccacaaccccggccaggagtcatccgggccctggggccgcctccaggggtacgtcgaaggccttgtgaacagatcagcccggaggaagaggagcgccgccgagtaaggcgcgagcggaacaagctggctgcggccaagtgcaggaaccggaggaaggaactgaccgacttcctgcaggcggagactgacaaactggaagatgagaaatctgggctgcagcgagagattgaggagctgcagaagcagaaggagcgcctagagctggtgctggaagcccaccgacccatctgcaaaatcccggaaggagccaaggagggggacacaggcagtaccagtggcaccagcagcccaccagccccctgccgccctgtaccttgtatctccctttccccagggcctgtgcttgaacctgaggcactgcacacccccacactcatgaccacaccctccctaactcctttcacccccagcctggtcttcacctaccccagcactcctgagccttgtgcctcagctcatcgcaagagtagcagcagcagcggagacccatcctctgaccccctgaaccgcacagctcaggaggcgcccttggcttctgtgatgagctgatctgcggatctcagctttgagaagccttcagctccagggaatccaagcctccacagcgagggcagctgctatttattttcctaaagagagtatttttatacaaacctaccaaaatggaataaaaggcttgaagctgtg

SEQ ID NO: 304438 - DNA, 4255 bp, Homo sapiens
gggttgcaagctgaactcattactggttttcataacaacacaatagtaagaacaagcaaacacaacaaattctcctggaggcagacttggcttaaaaaggcagacttggcttggtgatagtttttcttgaaagttccagatccacagtggagagtgagcctgtctcatatttggcaaaaatatttgttgaaatgtccacataggggatgttggatgtttaacacttttgagagtttaacacatgaatattctttctcctagaaaacacattagacctgttggagggagtctcccgtattccttttctgccacttttcgtccccatttcatttcattaatgataggatatgatttacctgtgacttactacttcaaatggatggcagtgcacttggatttttttttaatatccagaagattgaacagagggttgctattgttgaatgtatttggactgatagattaaaatcaaagttcaatttttaaggaacaaaaaagtaaatcctgttttcattttatctccccttttaaaactgagaaccagagcagaagggaaatatagaattttaagcaattaatcttcctgtggatgaattaaacccattagatgctgatgggatttttttaaggaatggtaccttaactatatatttgatttcgtttcccctgagggctagaggctgaatggaggctggttttattttgcctttccctcaccgcccagtcccattgagtgtattcattactagaaggaaaatctttcagaattggtgacacatggtaggctgtcttaaggagtcccctggcccccttcccctaggccatggcctaataaaataaactgtcaattgttctcacagcatatcatttaataatgaatactttagaacaatgcttatgggctggagaattgtatttgattagcccattcagtttgatagcccaaatgctgaacagcacagcgggatcctagcagtgcaagttcaaaagtaagtccaatcatttctgtgatactcgccctggtagcaaacagatcatctcagccaagctcttcatgtatctttgacctattaggtgaacaaatgaacctcacaggacacacagtattttttaaaggcagactcgctctcttttttgccagtgagcagttctagctaaccaagttacacactgtgggtattcctgcctgcctcttgaatacaaaggcctagttcaagtgttgctttttttatttcaaatcaattttttcttctttcctttttgagataaaactattaaaagtactactatatatataaaatctcaaatcaacttttcggcctcctcctcgtgtaccaggaagtatattctgacgaagggccccacttttgcaggtcttgcacgcccctcccttacccagaactgcagagcttcaggatggcgaaggtcacccaagggcatgagtagggagtggtgtctccaaccatcagttccgtggcactgttcagcctttgtgtgctgccctgccacccaccactcacagtgcctctgaagcgtgttacccctggagtgacgtgagcatttgaggcttgtctaaggaaaaaaataaaaggcagtgaaggagactgtacataaagacatggcaaaaatcttaattatagcaatatagttatcgggtaatgttcgggtgggcagctccattaaaaaatatgtgaatgaatctgtgaagctgcaagtagcgagaagagcgaaaggtcttcttaatgaaccgcctaccttgtagacagtaatttgtacactgtatagttttgttaagaattttttttaaattaaaattcccatgtttgtaaagctaactttttaacaattataatggaactatatgttgtttccatttttaaagtaaacaagaatattccttgtttagagactggacttgagttaaaactctccagtctcttaagttatgtattaaaaagaaaatctgtccatgttaggagttatttcacagattcctgtgcttgaaaagcataggatactaatcctttaaaaaagtgtaaatggagaaaagttatattttatgaaggttattttgttgtatttagtattggaaaagttggtttccagagcatttcagaatgtcgaagcaccactgtctttttattagtatatacggcctttagcaaaagtttttgtgattgttacgtgatggtatttaaggttaagtttcacagagcattcaggataggcagaaaactaaaacagtgctatgtctcacataacgtgtcctcagggagcagaatcttggatttgtgacttgtagcttcataaggactcaacgaaagagattgcacagggacatcttcagcggtgtgacagcaggacatgttctttacctagattcaaattctatgtactgtgtgaaatgatgaaggctgcagaaagttatcccatattcagtgtacagtattcatttttaatgaaacaactctacaatattgctggcagataggccccaagcatgacattcaatatagtttacatgttcctgtcaaggtcttttgttaacattaaccagctgcatgctttctggactttaagaaattgggtttctatagaaaactttttttttttttttttttttaatgtgcaggctattcaagttcaatagtaaaagctcaaaaatgaatgttctactccatgctgaaggagctgaaagctgccttcttcatattttgcactttctggtagttcccctgttttttctaattccctaaaattgtgtgggtggagtggagccctgcagttggggggtaacatggaccactgattttgccctttgaccctgcacaatgacctttgcatcagccaaactcattgccatgacaactctttgtactgtgtccgtgccacagatctgttggtcacattgttaatagtaaaggggacaagttggagacggtcaatttttacattttttgttgcaattttttcttcaatggttgtaagtagttttttttttttttaataataaaagggttcactagttaatactctagaaatatctgtgtgttgcaattcaaatgtatgttgagattgtgaaaagcgcttcagtgccactagcttaccggtacactagactaagcccttgatgacttattgcatgatacagtaccaggaacaacaggtggcctaaatacatgaaaagcagtgtaagctagtgacactaaagccagtcttgtattactgtatttttgacagaatggttttgaaaactgtgctacagggactgatgtggcaaatatatctctttatgcagaaggaagtctttttttttcttttttttttttttaagaagtatggctttttatgcatccttcatcgagggcattgaagttgcatggactgataaaagttgatgcaaaacaagaaagaaacaaacaaaaaaaaaaaaaccagcaaaatgtttaccaaaaaactcaaacaaatgagcagtgcctgttcaatttcacagtctctgttgagttcagttgtaaatatgtttcaaatgacattttcttgggaaaaaaaatctctacaacattgtagaatgtgaggggtaactacatcccaggcataggtttctcaaagctgcagtagattatgtcttcatcaagctgttaatttgtgcttatatcatatagaacttttagcatcctgggaagagctgcccccacctcaatgatatttctctgagaacaacttttgtaggactgtgtgtttctttagatacatttagtacaactgtaggtgacgagtagtcagttattgcttgctagctacacaccagggttgatccattttaaaacttttggcattttgtcctcatgggccataaatacagaaccttgtattttaattaaatttttttacaaaaggaggcacatgcacaatctccatgtaacaaacctttagcagtaggatgtattatacgacagttacttaatttctagagttcaggcctctgggatcaaccccagactgggccagaatgttagtgaaggttttattgtgcccggttggaggataacgttctttgggtactttttgtgggttgcaaatgaactcaattgccacaagttttaaactggtgtaaatcaagcttgacttaatgtgattgttactgttatatccagcctatactgctagcagctgctcatactgcagtcaattactggaagcggatatatttcctatgcaaaaactgtttaaacaataaaatgagctatgctacaga

SEQ ID NO: 304439 - DNA, 5612 bp, Homo sapiens
gggttgcaagctgaactcattactggttttcataacaacacaatagtaagaacaagcaaacacaacaaattctcctggaggcagacttggcttaaaaaggcagacttggcttggtgatagtttttcttgaaagttccagatccacagtggagagtgagcctgtctcatatttggcaaaaatatttgttgaaatgtccacataggggatgttggatgtttaacacttttgagagtttaacacatgaatattctttctcctagaaaacacattagacctgttggagggagtctcccgtattccttttctgccacttttcgtccccatttcatttcattaatgataggatatgatttacctgtgacttactacttcaaatggatggcagtgcacttggatttttttttaatatccagaagattgaacagagggttgctattgttgaatgtatttggactgatagattaaaatcaaagttcaatttttaaggaacaaaaaagtaaatcctgttttcattttatctccccttttaaaactgagaaccagagcagaagggaaatatagaattttaagcaattaatcttcctgtggatgaattaaacccattagatgctgatgggatttttttaaggaatggtaccttaactatatatttgatttcgtttcccctgagggctagaggctgaatggaggctggttttattttgcctttccctcaccgcccagtcccattgagtgtattcattactagaaggaaaatctttcagaattggtgacacatggtaggctgtcttaaggagtcccctggcccccttcccctaggccatggcctaataaaataaactgtcaattgttctcacagcatatcatttaataatgaatactttagaacaatgcttatgggctggagaattgtatttgattagcccattcagtttgatagcccaaatgctgaacagcacagcgggatcctagcagtgcaagttcaaaagtaagtccaatcatttctgtgatactcgccctggtagcaaacagatcatctcagccaagctcttcatgtatctttgacctattaggtgaacaaatgaacctcacaggacacacagtattttttaaaggcagactcgctctcttttttgccagtgagcagttctagctaaccaagttacacactgtgggtattcctgcctgcctcttgaatacaaaggcctagttcaagtgttgctttttttatttcaaatcaattttttcttctttcctttttgagataaaactattaaaagtactactatatatataaaatctcaaatcaacttttcggcctcctcctcgtgtaccaggaagtatattctgacgaagggccccacttttgcaggtcttgcacgcccctcccttacccagaactgcagagcttcaggatggcgaaggtcacccaagggcatgagtagggagtggtgtctccaaccatcagttccgtggcactgttcagcctttgtgtgctgccctgccacccaccactcacagtgcctctgaagcgtgttacccctggagtgacgtgagcatttgaggcttgtctaaggaaaaaaataaaaggcagtgaaggagactgtacataaagacatggcaaaaatcttaattatagcaatatagttatcgggtaatgttcgggtgggcagctccattaaaaaatatgtgaatgaatctgtgaagctgcaagtagcgagaagagcgaaaggtcttcttaatgaaccgcctaccttgtagacagtaatttgtacactgtatagttttgttaagaattttttttaaattaaaattcccatgtttgtaaagctaactttttaacaattataatggaactatatgttgtttccatttttaaagtaaacaagaatattccttgtttagagactggacttgagttaaaactctccagtctcttaagttatgtattaaaaagaaaatctgtccatgttaggagttatttcacagattcctgtgcttgaaaagcataggatactaatcctttaaaaaagtgtaaatggagaaaagttatattttatgaaggttattttgttgtatttagtattggaaaagttggtttccagagcatttcagaatgtcgaagcaccactgtctttttattagtatatacggcctttagcaaaagtttttgtgattgttacgtgatggtatttaaggttaagtttcacagagcattcaggataggcagaaaactaaaacagtgctatgtctcacataacgtgtcctcagggagcagaatcttggatttgtgacttgtagcttcataaggactcaacgaaagagattgcacagggacatcttcagcggtgtgacagcaggacatgttctttacctagattcaaattctatgtactgtgtgaaatgatgaaggctgcagaaagttatcccatattcagtgtacagtattcatttttaatgaaacaactctacaatattgctggcagataggccccaagcatgacattcaatatagtttacatgttcctgtcaaggtcttttgttaacattaaccagctgcatgctttctggactttaagaaattgggtttctatagaaaactttttttttttttttttttttaatgtgcaggctattcaagttcaatagtaaaagctcaaaaatgaatgttctactccatgctgaaggagctgaaagctgccttcttcatattttgcactttctggtagttcccctgttttttctaattccctaaaattgtgtgggtggagtggagccctgcagttggggggtaacatggaccactgattttgccctttgaccctgcacaatgacctttgcatcagccaaactcattgccatgacaactctttgtactgtgtccgtgccacagatctgttggtcacattgttaatagtaaaggggacaagttggagacggtcaatttttacattttttgttgcaattttttcttcaatggttgtaagtagttttttttttttttaataataaaagggttcactagttaatactctagaaatatctgtgtgttgcaattcaaatgtatgttgagattgtgaaaagcgcttcagtgccactagcttaccggtacactagactaagcccttgatgacttattgcatgatacagtaccaggaacaacaggtggcctaaatacatgaaaagcagtgtaagctagtgacactaaagccagtcttgtattactgtatttttgacagaatggttttgaaaactgtgctacagggactgatgtggcaaatatatctctttatgcagaaggaagtctttttttttcttttttttttttttaagaagtatggctttttatgcatccttcatcgagggcattgaagttgcatggactgataaaagttgatgcaaaacaagaaagaaacaaacaaaaaaaaaaaaaccagcaaaatgtttaccaaaaaactcaaacaaatgagcagtgcctgttcaatttcacagtctctgttgagttcagttgtaaatatgtttcaaatgacattttcttgggaaaaaaaatctctacaacattgtagaatgtgaggggtaactacatcccaggcataggtttctcaaagctgcagtagattatgtcttcatcaagctgttaatttgtgcttatatcatatagaacttttagcatcctgggaagagctgcccccacctcaatgatatttctctgagaacaacttttgtaggactgtgtgtttctttagatacatttagtacaactgtaggtgacgagtagtcagttattgcttgctagctacacaccagggttgatccattttaaaacttttggcattttgtcctcatgggccataaatacagaaccttgtattttaattaaatttttttacaaaaggaggcacatgcacaatctccatgtaacaaacctttagcagtaggatgtattatacgacagttacttaatttctagagttcaggcctctgggatcaaccccagactgggccagaatgttagtgaaggttttattgtgcccggttggaggataacgttctttgggtactttttgtgggttgcaaatgaactcaattgccacaagttttaaactggtgtaaatcaagcttgacttaatgtgattgttactgttatatccagcctatactgctagcagctgctcatactgcagtcaattactggaagcggatatatttcctatgcaaaaactgtttaaacaataaaatgagctatgctacagactctggcctcatgttttatttttctcctcatcgtctccttgctgttctgcctacattaatgttgggtcagtagtgtcccagaaattgatcttggcccttaactttgggggttttgtagcactgatttaattattagcatctgggatagttaatatttcagttcaatatttaaccgtatatctgtgtatatctatataatccttccttgcagttcctaataaatacagtcatcccaagctttctaaacaatgacagtaaaaaaaaaaaaaagaaagtgcagttatagaatcgcagacctcactctctgagaaaggcctttgagcaatacgttgaagacgatgtgtgccatgatgactggactgtggtctctgtgagagaaaaaccacagggcatcaaacactgaacagaaaaggtaagccccggggacaccctgtggctgtgggtttagtggttacatgaatactgcaggagagcaatttcttcctgcaaatgcctgaaaaggagcagcatcttgtgtttccaagaagcagtgctacttttcaacacaagcaggggtgatgttcccttttcacagggagacatacacaagggctaaaaccgaggaccgggtcccaaatccagcctcactgaaagcagcatttctgaatggagtcagctggagttcaataatagctaattgaaaaggaatgagcttaaatggttttgtgatccatctgagtgatgtgcataaatgaagcaaaaataatgcaagcttcattgaaaatagagataaaaatgcctggaatttgactatcccaaccaaagacttgctgagacagatctgactgcctgatccgaccaactctgatttgtggctgaggtttctttcatgtccccaaaccaccctggtttccaccactgtgtgtggagtcgtatggaaattgatggactataatatcctggaaaaaaaaaattggagaatcctggaagtatgagacagtaattggatttcttagaaaatgaagacatttcttaagaaatgtttgagaatattatcattgaaataaaacttttacctatagagagatttttgcctttttaaaaacgtttggctctattggcagagatcaagatttaggctgaggcggatggattgcttgagcccaggagttcaagaccagcctgggcaacatggtgacactcccatctctacaaaacatacaaaaattagccaggcatggtggtacatgtctgtttttccagctactcaggaggctgaggtgaaaggatcacctgagcctgggaggttgaggctgcagtgagccatgatcttgccgctgcactccagcgcctgggtgacagagcaagaccttgtctc

SEQ ID NO: 304440 - DNA, 617 bp, Homo sapiens
gcctactactactaaattcaaaaccgcgtcgacccacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 304441 - DNA, 655 bp, Homo sapiens
agcgggtcgacccacgccgtggctgacagcgacgtattgtcgctgtcgtccagctgtgcgaaggatgatctcgacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 304442 - DNA, 622 bp, Homo sapiens
tacataatagcgtcgggggcaagtaagtgtggaagacgagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 304443 - DNA, 389 bp, Homo sapiens
aggtgttaaaaaaggtttgcttgtttctttcatgcaaatactaatgtagcccttttttcttagcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 304444 - DNA, 1228 bp, Homo sapiens
ttaggaaggctctatttccctacagtatctttgtaatgcatctgaaatccaccattgatgcttaacgtcaatgaaaagcacggagtttggcgcaaagctgcctctttcccttgtgcaactacagcgcagacatacattcttattcctggatatttaatagaaacattgactctgcttctgagaattgagacccttgtcaccataaatatttaagcagaaattgaatggtcatctatcaagggtgtgaaagaagatactttggaatatattgtttttaaggttcattttaactttcaacactgaatgctcctcttgaccatctgatcagtatgtgctttgttgtgacagtatcctatcatgtacagcacggaccctgaaaatgggcacatcttcaactgcattcagcgagcccaccagaacacgtgagtgtcggccctgccgggcaccaaagacatctgcagagtgggtgttttctgtctaacacctcagcccttagtgcgctgtatttgctgagtcatagtgatggtgacaatcatgggcacctcattaaaagtattcaaaaattatgtatgtgaacacattgactattaagcaaacttaagagtggttggaatggtgggatttcgggatattcttttcacaaaaatgtcttcatggttgcattacctactacagttttgcagcatgacccatctaaaccgatgttgactctcccaggcctagggagtgaagaggttttgaatgctgtaaggaaacccactctgactcaccaggaccttccacttccatttgttagatgtgaggtccttttactcagcatgttccaagtgacctctaatcccatgcagagcaaaggagggtggatgatagtgaccaggtcttctccctgcggtgaatgtttatttttacccccaagcttctaacttggcaaggaagatgtaaagattcatagtgctggctgggtgaggtgggctcacacctgtaatcccagcactttgggaggccgaggtgggtggatcacttgaggtcaggagttggagacaagcttggtcaacatggcaaaaccccatctctacaaaacttagccaggcatggtggcacgcacctgtaatcccagctactcaggaagctgaggcatgagaattacttgaacccgggaggcggaggttgcagtgagctgagatcatgccactgcattccagcctgggtgacagagacactccgtctc

SEQ ID NO: 304445 - DNA, 1004 bp, Homo sapiens
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtatttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 304446 - DNA, 702 bp, Homo sapiens
atccttaattaaattaatcccctccccccccgctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 304447 - DNA, 1048 bp, Homo sapiens
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtatttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagggacaggagatgccctggaggggaaggcgcttccggctctgcagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 304448 - DNA, 1089 bp, Homo sapiens
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtatttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagtaataaagcatcttgctccctaaggcttcacaccatgaaatagccacagtgctgggggccgtcccaacgtgttctttcttccacaacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 304449 - DNA, 1100 bp, Homo sapiens
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtatttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagggacagatcttccatcctcctaacatatagttagcttccactctccaaatattccaccagcaacattgatgaatattgaagactatggactgtgagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 304450 - DNA, 1160 bp, Homo sapiens
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtatttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaaaaaaaaaaaaaaaaaaactcgagggggggcaggtccccattcgcccaaagtaggcggtttccattaattggccgcgttttcaccgccgacctggaaaaccctgggttcccaaattattcccttgagaaatccccttttgccattggcttaattcta

SEQ ID NO: 304451 - DNA, 1341 bp, Homo sapiens
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtatttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaaaaaaaaaaaaaaaaaaaaaaaaaaaaaaaaaaaaaaaaaaaaaaaaaaaaagaaaaaaaaaaaaaaaaaagacggggagggcgggccgtagcagaagattaccctcccgcgggggagggcgaacgccgacctgcggcgcgtgcccgcgcgcggcttcagccgctgaacaaaaggggcgggcaccctcgcgaggggggcgcgctccttacgtagcgccggcgcgagcgcgcgggagtaagcacccgcggggggggggaggaagaacaagccctcgggggcgggagtgcggggggcagacgcccctccggggcgcgacaactcgggggcgccccgccgg

SEQ ID NO: 304452 - DNA, 569 bp, Homo sapiens
tcggacagtccactctatacgatcccctgtattggtggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 304453 - DNA, 1045 bp, Homo sapiens
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtatttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaaaaaaaaaacacttcaagcattatttcggtgcgcaaaaataa

SEQ ID NO: 304454 - DNA, 1529 bp, Homo sapiens
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtatttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaactcctgactcttaccactcatttccgtttgagtctgtatctgaaatcagtagcctagtcctactagatgagaaaggagccacaagtattgtgccctctcctcacccttccagcagatgcttctgtagtatgtgaggttgagaaaaagtctgattgtggtgatgtaggtatagtcatgccacagtgatgaaaaattaaagaaaaatcttctagctctcaggatatgcattatcacttgctacagatactccaaggccaaaggaatgcttgagcctaaaagttcaagaccagcctgggcaacatagcaaaaccccatctctacaaaaaaatatacaacagttagccaggcatgatggcacatgtctgcagtcccagctacttgggaggctaaggtgggaggatcacttgagcccagggtgtcaaggctgcagtgagttatgatcacactgctgcactccagcgtgggtgacagagcaagaccctgtctcaaataaataaaaattaagtttctattaaagattgtttc

SEQ ID NO: 304455 - DNA, 1058 bp, Homo sapiens
  misc_feature (1058)..(1058): n is a, c, g, or t
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtatttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaaaaaaaaccaaaaaaaccggagacaaggtcccccccggagggcggacccaaagan

SEQ ID NO: 304456 - DNA, 806 bp, Homo sapiens
ttaggaaggctctatttccctacagtatctttgtaatgcatctgaaatccaccattgatgcttaacgtcaatgaaaagcacggagtttggcgcaaagctgcctctttcccttgtgcaactacagcgcagacatacattcttattcctggatatttaatagaaacattgactctgcttctgagaattgagacccttgtcaccataaatatttaagcagaaattgaatggtcatctatcaagggtgtgaaagaagatactttggaatatattgtttttaaggttcattttaactttcaacactgaatgctcctcttgaccatctgatcagtatgtgctttgttgtgacagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 304457 - DNA, 904 bp, Homo sapiens
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtatttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggttt

SEQ ID NO: 304458 - DNA, 930 bp, Homo sapiens
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtatttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggaggttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 304459 - DNA, 958 bp, Homo sapiens
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtatttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctggttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 304460 - DNA, 958 bp, Homo sapiens
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtatttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgtaacttctgttctttcttctttttcagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 304461 - DNA, 783 bp, Homo sapiens
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtatttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccggacattgggaacagggagacttttccctcgaagaccatgtattctgggagaagcgctccccttctttctagtggagctacacccccagtgtagcctgcagaacca

SEQ ID NO: 304462 - DNA, 991 bp, Homo sapiens
tcggacagtccactctatacgatcccctgtattggtggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgtgagtgtcggccctgccgggcaccaaagacatctgcagagtgggtgttttctgtctaacacctcagcccttagtgcgctgtatttgctgagtcatagtgatggtgacaatcatgggcacctcattaaaagtattcaaaaattatgtatgtgaacacattgactattaagcaaacttaagagtggttggaatggtgggatttcgggatattcttttcacaaaaatgtcttcatggttgcattacctactacagttttgcagcatgacccatctaaaccgatgttgactctcccaggcctagggagtgaagaggttttgaatgctgtaaggaaacccactctgactcaccaggaccttccacttccatttgttagatgtgaggtccttttactcagcatgttccaagtgacctctaatcccatgcagagcaaaggagggtggatgatagtgaccaggtcttctccctgcggtgaatgtttatttttacccccaagcttctaacttggcaaggaagatgtaaagattcatagtgctggctgggtgaggtgggctcacacctgtaatcccagcactttgggaggccgaggtgggtggatcacttgaggtcaggagttggagacaagcttggtcaacatggcaaaaccccatctctacaaaacttagccaggcatggtggcacgcacctgtaatcccagctactcaggaagctgaggcatgagaattacttgaacccgggaggcggaggttgcagtgagctgagatcatgccactgcattccagcctgggtgacagagacactccgtctc

SEQ ID NO: 304463 - DNA, 1073 bp, Homo sapiens
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtatttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagtaataaagcatcttgctccctaaggcttcacaccatgaaatagccacagtgctgggggccgtcccaacgtgttctttcttccacaacgcaagatggctgtcctctctaaggaatatggttttgtgcttctaactggtgctgccagctttataatggtggcccacctagccatcaatgtttccaaggcccgcaagaagtacaaagtggaggtaagtgggaacacaagctggtgcccttgtaggcttgtctgggggccacaggcttagccaagaacttattttcagccatggagggagaggcaaggagctagttgtgagaagtggcagtttcaggactgtgttagcgattctgcttcttcatggtaggaaagaggcaagaaatacagggccctgctagggagtagtttccatcttgtttgactttgtctcttcggtagaaagaccaggaatgctgggattccaatagtacacttctgcttggagctatttgctaggaagagagttactgtattttccacagagggttaaatagcaatattgtttcatggtgtgccactttaaaaatgatgtcttatggtgattttcctgttttccaagtagaaaagaggtatgtggtgttgagattagcctggacttagacataggaaggtgg

SEQ ID NO: 304464 - DNA, 447 bp, Homo sapiens
atactactgtggcacgttacttggcatgtggtatctgacttgccaacagcttcaggctaaagagttagttaacctcctaaggccagtttgtctaatgtacaacctcagatgcgatgatagaatggcttgcgaatgttgaaagcatcataattctggagcactcctggtaacttctgttctttcttctttttcagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 304465 - DNA, 660 bp, Homo sapiens
ccctgccagtgtctccgccggttgaaagcgcgtgtctgcgtcgggttctgttggagtgcgttcggtgcgccgtgggtccgcgctgcttccacccaacttcctgttagtttctctcctgtcacaatggcatgatctcggctcactgcgacctctgcttcctgggttcaaggattctcctgcctcagcctcccaagtagctgggattacagtttccatcattatcttctatggagttcttcattcccacatctgtggaccttaaaatcctaccgttgagtgcctgccttggatcagcagtcagttcgttaccttggttctcagacgatgcttgcaacaacgccatgcgattcgcccactcttggagaaaataagagaagtatccctgaaggatgaaatatcctcgaatatgaaaaggtctgctctctgaagaccaactgtctcagtctgctttttgctgctgtaacagaataccacagacttgtaggcagagaagccttcagagaaggatcctgactcggtggtttgtgcagtgacatttggcagtgttttctcggcaagcgagtctttgaggctgccctcatgctgctcagtgggcacaccaagaacaagagctggccagggatgacggacgcatctaggccttctcggcctaagggcaag

SEQ ID NO: 304466 - DNA, 2046 bp, Homo sapiens
ccctgccagtgtctccgccggttgaaagcgcgtgtctgcgtcgggttctgttggagtgcgttcggtgcgccgtgggtccgcgctgcttccacccaacttcctgttagtttctctcctgtcacaatggcatgatctcggctcactgcgacctctgcttcctgggttcaaggattctcctgcctcagcctcccaagtagctgggattacagtttccatcattatcttctatggagttcttcattcccacatctgtggaccttaaaatcctaccgttgagtgcctgccttggatcagcagtcagttcgttaccttggttctcagacgatgcttgcaacaacgccatgcgattcgcccactcttgggttacattagttatacactctggaggtgacttgacctgtcattgtgaacaattattgctcttggacgacccaggacataggccagccagtacttaccccagtgtgttggagaatcgcgctcggcttcttcctctgtgctgagtcatgaaagttgccggagcaggtgcagttacacaacctccaggtatgatcctgtttaaggactggatttaggataactacttagaggttaaaagtcacaagggtgtatggatgaggctggagtgatctgggaccaaagacatctaggcttgctgtcaaggcttctgatcaacatgagatgaccgccgtgtggtaaactgatgaaccccgacgctgatcaacatgagatgaccgccgtgtggtaaactgatgaaccctgaccctgatcaacatgagatgaccgccgtgtggtaaactgatgaaccccgaccctgatgaacatgagatgaccgccgtgtggtaaactgatgaaccccgaccctgatcaacatgagatgaccgccgtgtggtaaactgatgaaccctgacccattaggctttggctacagaatgtggaaataagttgtgttactacatgtgtgtaatcctagggtgcaggacaccggccgggaggttccatagagtgatgggttctgcaggtaactcatcctctagtcctctgtaagctcctagaaggaagaaattatgtcctttagactaataaaattcctccaaaccaaatacagcacctactgtgaagacacaaagatacttttagaatagtaaaaactttatccattgagaaattccttaatgaaacagtatccaagaagtcatttgccagcagatttcttagaggtgcgataaagaagaggacattgccagtcgtcacagcagctgcaatagctcctctctattgttaaacagtgggatatcttgtgcaggttttcagttgacaatcaattttaaagattagtttcggtccccatcaatcaattatttattaacccatcaataaaaatttaaatgctctgtgaggtacaatagctattaaaagagacagaggcactttctgtgtccagaggggcttttagtctgctctggaaagcaagatgcgtgcagatgagtgacgcagtgcatcgtgtggatgcaaagggagggactcacatgggaaccagaggagctacgaagggaggcagtggggactggtgggtcgagacctggaaataacacatgaataggcaacaaaggtttcctttcctcttccatgcacttcagtccttgaaaaacgtcttaccacggaattccacagcgtaccaagcgattccacagcttgatggcacactctcctttctcagcattcttgaaaatggcgtgtgagccaagccatcttactgagaaattaccttaaaccatttgatgaaccaaaaatattttgtaatacccatctccgacattaggtaggcaaatcacacagaaacaccgaggtcttctgagtcatatttatctgaaaaatcacagcttgggtgcatgtgaagccagaggagcactcctgggggcctgcggtgccattcacttcagctcccctggggctttcacatgggccatgggagcacccaggcaagtgtagggctcttgagccttcagggaggggcggcatcagccagcaccatcgtctcctggg

SEQ ID NO: 304467 - DNA, 1920 bp, Homo sapiens
gggaaaatgtcttggatacatcttgcgtaatgaggagaaaaatgcagccatgttgcagcctgatgaaatactctgccagtgtcctgccataaaatgacaggcgaattttcagtaacagattctctaatagttctatggtcttctaggtgctaaactgtttaagtatctacattttctaagcccgcctaatggaaatattctcaaaaaacataaacccttcattctttctcaaataggttacattagttatacactctggaggtgacttgacctgtcattgtgaacaattattgctcttggacgacccaggacataggccagccagtacttaccccagtgtgttggagaatcgcgctcggcttcttcctctgtgctgagtcatgaaagttgccggagcaggtgcagttacacaacctccaggtatgatcctgtttaaggactggatttaggataactacttagaggttaaaagtcacaagggtgtatggatgaggctggagtgatctgggaccaaagacatctaggcttgctgtcaaggcttctgatcaacatgagatgaccgccgtgtggtaaactgatgaaccccgacgctgatcaacatgagatgaccgccgtgtggtaaactgatgaaccctgaccctgatcaacatgagatgaccgccgtgtggtaaactgatgaaccccgaccctgatgaacatgagatgaccgccgtgtggtaaactgatgaaccccgaccctgatcaacatgagatgaccgccgtgtggtaaactgatgaaccctgacccattaggctttggctacagaatgtggaaataagttgtgttactacatgtgtgtaatcctagggtgcaggacaccggccgggaggttccatagagtgatgggttctgcaggtaactcatcctctagtcctctgtaagctcctagaaggaagaaattatgtcctttagactaataaaattcctccaaaccaaatacagcacctactgtgaagacacaaagatacttttagaatagtaaaaactttatccattgagaaattccttaatgaaacagtatccaagaagtcatttgccagcagatttcttagaggtgcgataaagaagaggacattgccagtcgtcacagcagctgcaatagctcctctctattgttaaacagtgggatatcttgtgcaggttttcagttgacaatcaattttaaagattagtttcggtccccatcaatcaattatttattaacccatcaataaaaatttaaatgctctgtgaggtacaatagctattaaaagagacagaggcactttctgtgtccagaggggcttttagtctgctctggaaagcaagatgcgtgcagatgagtgacgcagtgcatcgtgtggatgcaaagggagggactcacatgggaaccagaggagctacgaagggaggcagtggggactggtgggtcgagacctggaaataacacatgaataggcaacaaaggtttcctttcctcttccatgcacttcagtccttgaaaaacgtcttaccacggaattccacagcgtaccaagcgattccacagcttgatggcacactctcctttctcagcattcttgaaaatggcgtgtgagccaagccatcttactgagaaattaccttaaaccatttgatgaaccaaaaatattttgtaatacccatctccgacattaggtaggcaaatcacacagaaacaccgaggtcttctgagtcatatttatctgaaaaatcacagcttgggtgcatgtgaagccagaggagcactcctgggggcctgcggtgccattcacttcagctcccctggggctttcacatgggccatgggagcacccaggcaagtgtagggctcttgagccttcagggaggggcggcatcagccagcaccatcgtctcctggg

SEQ ID NO: 304468 - DNA, 1709 bp, Homo sapiens
ccctgccagtgtctccgccggttgaaagcgcgtgtctgcgtcgggttctgttggagtgcgttcggtgcgccgtgggtccgcgctgcttccacccaacttcctgttagtttctctcctgtcacaatggcatgatctcggctcactgcgacctctgcttcctgggttcaaggattctcctgcctcagcctcccaagtagctgggattacaggtatgatcctgtttaaggactggatttaggataactacttagaggttaaaagtcacaagggtgtatggatgaggctggagtgatctgggaccaaagacatctaggcttgctgtcaaggcttctgatcaacatgagatgaccgccgtgtggtaaactgatgaaccccgacgctgatcaacatgagatgaccgccgtgtggtaaactgatgaaccctgaccctgatcaacatgagatgaccgccgtgtggtaaactgatgaaccccgaccctgatgaacatgagatgaccgccgtgtggtaaactgatgaaccccgaccctgatcaacatgagatgaccgccgtgtggtaaactgatgaaccctgacccattaggctttggctacagaatgtggaaataagttgtgttactacatgtgtgtaatcctagggtgcaggacaccggccgggaggttccatagagtgatgggttctgcaggtaactcatcctctagtcctctgtaagctcctagaaggaagaaattatgtcctttagactaataaaattcctccaaaccaaatacagcacctactgtgaagacacaaagatacttttagaatagtaaaaactttatccattgagaaattccttaatgaaacagtatccaagaagtcatttgccagcagatttcttagaggtgcgataaagaagaggacattgccagtcgtcacagcagctgcaatagctcctctctattgttaaacagtgggatatcttgtgcaggttttcagttgacaatcaattttaaagattagtttcggtccccatcaatcaattatttattaacccatcaataaaaatttaaatgctctgtgaggtacaatagctattaaaagagacagaggcactttctgtgtccagaggggcttttagtctgctctggaaagcaagatgcgtgcagatgagtgacgcagtgcatcgtgtggatgcaaagggagggactcacatgggaaccagaggagctacgaagggaggcagtggggactggtgggtcgagacctggaaataacacatgaataggcaacaaaggtttcctttcctcttccatgcacttcagtccttgaaaaacgtcttaccacggaattccacagcgtaccaagcgattccacagcttgatggcacactctcctttctcagcattcttgaaaatggcgtgtgagccaagccatcttactgagaaattaccttaaaccatttgatgaaccaaaaatattttgtaatacccatctccgacattaggtaggcaaatcacacagaaacaccgaggtcttctgagtcatatttatctgaaaaatcacagcttgggtgcatgtgaagccagaggagcactcctgggggcctgcggtgccattcacttcagctcccctggggctttcacatgggccatgggagcacccaggcaagtgtagggctcttgagccttcagggaggggcggcatcagccagcaccatcgtctcctggg

SEQ ID NO: 304469 - DNA, 1053 bp, Homo sapiens
aagggtagcgagcgcgactgcgtgttccatcggtcatcctctagtcctctgtaagctcctagaaggaagaaattatgtcctttagactaataaaattcctccaaaccaaatacagcacctactgtgaagacacaaagatacttttagaatagtaaaaactttatccattgagaaattccttaatgaaacagtatccaagaagtcatttgccagcagatttcttagaggtgcgataaagaagaggacattgccagtcgtcacagcagctgcaatagctcctctctattgttaaacagtgggatatcttgtgcaggttttcagttgacaatcaattttaaagattagtttcggtccccatcaatcaattatttattaacccatcaataaaaatttaaatgctctgtgaggtacaatagctattaaaagagacagaggcactttctgtgtccagaggggcttttagtctgctctggaaagcaagatgcgtgcagatgagtgacgcagtgcatcgtgtggatgcaaagggagggactcacatgggaaccagaggagctacgaagggaggcagtggggactggtgggtcgagacctggaaataacacatgaataggcaacaaaggtttcctttcctcttccatgcacttcagtccttgaaaaacgtcttaccacggaattccacagcgtaccaagcgattccacagcttgatggcacactctcctttctcagcattcttgaaaatggcgtgtgagccaagccatcttactgagaaattaccttaaaccatttgatgaaccaaaaatattttgtaatacccatctccgacattaggtaggcaaatcacacagaaacaccgaggtcttctgagtcatatttatctgaaaaatcacagcttgggtgcatgtgaagccagaggagcactcctgggggcctgcggtgccattcacttcagctcccctggggctttcacatgggccatgggagcacccaggcaagtgtagggctcttgagccttcagggaggggcggcatcagccagcaccatcgtctcctggg

SEQ ID NO: 304470 - DNA, 382 bp, Homo sapiens
cccatatcctcgtccgttgtggcactgagagcagctaactgttgccctcgttggttcccagttggcttccgtgactggtcagggtcaggtccactgccaacaggctggtgttgaatcccttggagaaacacagacattctgaccctaaattatgctttcaatgccatgtgttttcttatcacaaaaatcctcgttctcaagtttcttctttctttatttttatttcatttcattttttagcattcctccacaattcattgcccaaatctactttttactcaatttacttgctttggtcatttttcaatatagcactttaatttcttagacaaatattttcaacattctcctgttttctcaaggatgtctgttttctccccag

SEQ ID NO: 304471 - DNA, 311 bp, Homo sapiens
taaaattcctccaaaccaaatacagcacctactgtgaagacacaaagatacttttagaatagtaaaaactttatccattgagaaattccttaatgaaacagtatccaagaagtcatttgccagcagatttcttagaggtgcgataaagaagaggacattgccagtcgtcacagcagctgcaatagctcctctctattgttaaacagtgggatatcttgtgcaggttttcagttgacaatcaattttaaagattagtttcggtccccatcaatcaattatttattaacccatcaataaaaatttaaatgctc

SEQ ID NO: 304472 - DNA, 793 bp, Homo sapiens
tgataatggcattaatccattcagcagggcagagccttcgtgaccccatcacctcttaaggctcccgctcagcatggttgcactggggttaaatttctaacacctgaactttggggacatgttcaaaccatagccagggccctgagaaacccatttccactgacttcaaaatagttcatgaaaatggagtgctgagagagcagcagggcattcacaagaatggttttgagaggcctcactgtgccaggcatggccctcagggcaggcagctctgcacagccccccatggcagcagctggtcaggctgcccaaactcaccactttggaatcacttcagcaccacctgtcttcacttgaaatcaattgtctgcagattttaaactcgtttctatgtgcccagtaggcagagaagccttcagagaaggatcctgactcggtggtttgtgcagtgacatttggcagtgttttctcggcaagcgagtctttgaggctgccctcatgctgctcagtgggcacaccaagaacaagagctggccagggatgacggacgcatctaggccttctcggcctaagggcaagtcccattcttccttgataggtctttagatgtaccagtcagcaaatgtcatccccctctgcattcacgtcaagctgtgcagggaatgctaaacagaggcagatctaaacttaggagttaggcttcttctccatggagatgtggatctgcacagacaaagtgtccaagtgggattttcctgctatttcaaggactgctgctgcaccctgctggctc

SEQ ID NO: 304473 - DNA, 1703 bp, Homo sapiens
  misc_feature (141)..(141): n is a, c, g, or t
aatttgtaaagaaaaaaaaatttttggggggggtttccaaaattttggcgccaaaataaattttccagagttgggtggccttggcccatttaaaaaaaaaaagggggggggggaaaaaggggccaaaaaggtggcaaaccnctatccccaaagccatatacatatctataatacagaagtaagaataaagtcataagtaccagcatattttaaatccttagaagcactggttgggatgttacatgttttttcactgttgttgtttaccgttagctctcaaagcagtgggaatagtgcttggcacatagtaggagtttggtaaacatttggaaattgaagacccagcttatcactccttcatagagactcagtagtatgagtataccccaaattgaatgagccacagagaaatgcatccagccacactccctcttagctgaggagaagcctctgtgaatccacagattccatgcaatattcagccagccgcagacacaaggtctggctcccttgtcgtgagagtgaaggcatgctgcacacagtgggtttgcatgcacctagactgcatctgctgaacacccaacagctgtttctacaagctaaagttgtagcttctctctaccactgtctaaagctgtagcttgtctctactattgtctctacaccgttgcccaaacacttggtataatgctattgaatttttcacctccaggcatgattttgtaaccaatgtaaaggttctgggttcagccagtctaaaaagtctaataatttcttctctcagtccttcccttctcccttgtctggagctgccaccgccatttaaaagtgttggacgctgtttattcccagcttctcaacctcagtgtgtgtggggaaaggcctgaaagagagaggtatgttttctctcctccagagtctctgtggtgttgacacagcagagagaggagggggagcagcctcgtcttgcagaatcaccttcaatcactgctactgtctgggccattactgccagtctggccggtgtctcccacagtggatggctttgctccagcggtggaccagtgtgtacctgacatgtatcagacttctgagctcttcaagctgcctcaaagaatgaatctttttagtctagaaaatgtgtttatttgataaatatactattgtgtatgagtgtgaaacaatgcagactttggagtatctcattagaaggactgtatgaatttatagaaaattgaatctaatttcagaagagcgcactgtcttctcagtcaacaaggttgcccagccacagagggtcagagaaaatgtcctttcccctccccactccttttcatagaatcctctctcaggcctaactgagctgtcatatccaattcagactgacacagagtgaggggcgctgagagtctctatgtatataaagatataggaagaaaataaggatcatcacaggaatctgttgggcttctccccatgactgtgatcttacccatgtttgaatcacaaactttaaatttataataattatgattcttgcagttttcaagtaatttgttaaatgcctattcaacacagacagatttttattttcagctgtggcttgtaaatgcctacaaactgattcatgttggtggtcgttatgacactttctgtgaattggtgaataaatatgattttagaattttcacagtaaaaaaaaa

SEQ ID NO: 304474 - DNA, 840 bp, Homo sapiens
gctatggacagctgattatatatatgtgtgtgtgtgtatatgtgtgcatatatgtgtacatatacacataccccaaagccatatacatatctataatacagaagtaagaataaagtcataagtaccagcatattttaaatccttagaagcactggttgggatgttacatgttttttcactgttgttgtttaccgttagctctcaaagcagtgggaatagtgcttggcacatagtaggagtttggtaaacatttggaaattgaagacccagcttatcactccttcatagagactcagtagtatgagtataccccaaattgaatgagccacagagaaatgcatccagccacactccctcttagctgaggagaagcctctgtgaatccacagattccatgcaatattcagccagccgcagacacaaggtctggctcccttgtcgtgagagtgaaggcatgctgcacacagtgggtttgcatgcacctagactgcatctgctgaacacccaacagctgtttctacaagctaaagttgtagcttctctctaccactgtctaaagctgtagcttgtctctactattgtctctacaccgttgcccaaacacttggtataatgctattgaatttttcacctccaggcatgattttgtaaccaatgtaaaggttctgggttcagccagtctaaaaagtctaataatttcttctctcagtccttcccttctcccttgtctggagctgccaccgccatttaaaagtgttggacgctgtttattcccagcttctcaacctcagtgtgtgtggggaaaggcctgaaagagagaggtatgttttctctcctcca

SEQ ID NO: 304475 - DNA, 365 bp, Homo sapiens
gttctcactctgtcatccaggctggagtgcagtggcacgatctcagctcactacaacctctgcctcctgggttcaagcaattctcctgccttaacctcccaagtagctgggactacaggcgtgctccaccgcacccagctaattttggtatttttagtagagacagggtttcaccatgttggccaggctggtctcgaactcctgacctcaaatgatccacccgctacggcttccaaaagtgctgggtttacaggcgtgagccacagcacccagcctcagacatattagttttaattatttttagcaagttactactttccttagctatatccatcctcatgcagcatcttttcctagaatgtctc

SEQ ID NO: 304476 - DNA, 2454 bp, Homo sapiens
taggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccagtttccagaagggctggggtgagatcctgacctgtgcagagagtggggaggcgtcagcgcctggccagggctgccccagtcctttggtgcccggtgagcgcagccagcaggagctgagcagcgggggagatgaatcacctcctgccttggcgaggcggcagctcattgtttacaggcaagccctgctcctgggagggctcctgccaccccacccttcctctgtgtgttatctctgccccacagcagcccctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacacactcgggcacttcaggaggtcagttctcaccccttcctcgatggggctttaaagctctggggagaagagctgctccccactcatgccccagagggactgtgaaaaggcttcctgtgacctccgatggcggcccctcattggccaagggcactgtggatgttttgtgggaggcagcatggcaccgtggaaagggcagtagacgtggagccggcacctctggtctggattccacttaaaaccagttgagtggtctcaagcccttaacctctgtaagcctgtttcttctctgaaatcacagtaataaagcgtcgtaagatggttgggaagaacca

SEQ ID NO: 304477 - DNA, 1197 bp, Homo sapiens
taggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattctta

SEQ ID NO: 304478 - DNA, 2122 bp, Homo sapiens
taggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccagtttccagaagggctggggtgagatcctgacctgtgcagagagtggggaggcgtcagcgcctggccagggctgccccagtcctttggtgcccggtgagcgcagccagcaggagctgagcagcgggggagatgaatcacctcctgccttggcgaggcggcagctcattgtttacaggcaagccctgctcctgggagggctcctgccaccccacccttcctctgtgtgttatctctgccccacagcagcccctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacac

SEQ ID NO: 304479 - DNA, 2043 bp, Homo sapiens
taggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccatcctttggtgcccggtgagcgcagccagcaggagctgagcagcgggggagatgaatcacctcctgccttggcgaggcggcagctcattgtttacaggcaagccctgctcctgggagggctcctgccaccccacccttcctctgtgtgttatctctgccccacagcagcccctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacac

SEQ ID NO: 304480 - DNA, 2441 bp, Homo sapiens
taggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccagtttccagaagggctggggtgagatcctgacctgtgcagagagtggggaggcgtcagcgcctggccagggctgccccagtcctttggtgcccggtgagcgcagccagcaggagctgagcagcgggggagatgaatcacctcctgccttggcgaggcggcagctcattgtttacaggcaagccctgctcctgggagggctcctgccaccccacccttcctctgtgtgttatctctgccccacagcagcccctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacacactcgggcacttcaggaggtcagttctcaccccttcctcgatggggctttaaagctctggggagaagagctgctccccactcatgccccagagggactgtgaaaaggcttcctgtgacctccgatggcggcccctcattggccaagggcactgtggatgttttgtgggaggcagcatggcaccgtggaaagggcagtagacgtggagccggcacctctggtctggattccacttaaaaccagttgagtggtctcaagcccttaacctctgtaagcctgtttcttctctgaaatcacagtaataaagcgtcgtaagatggttgggaagaaccagaggtgacttatgcaaaagctttataaactgtaaagttcctgccagtg

SEQ ID NO: 304481 - DNA, 919 bp, Homo sapiens
taggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaagcttgttgcagggacgtgtctgcagcgcctggggaccggagctgtccttcccctgtgcgggcgggcaccgcctcctcctgggtgtgaggaggaggggcctggccaaacggttctgggcatgtgaggtggggcggtgggcggggggtgccgggcatgtgcagagacctggtgatgccgggagggatacagtactgtttggaaagttcttttaagagtgaaaagccc

SEQ ID NO: 304482 - DNA, 463 bp, Homo sapiens
ctgggctcagccttgctactttgagaagcacctttggagtctgggatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattctta

SEQ ID NO: 304483 - DNA, 415 bp, Homo sapiens
aggggccaccctaggacttgaaaggaccgtgcagcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattctta

SEQ ID NO: 304484 - DNA, 819 bp, Homo sapiens
taggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggtatttggtgttggctgtggtgggtggctggatgcaaacaaggtgtttgaacactgtggctcagttcgtatgtttggtcaagatctgtcccactgacaaactgtgcaactgtgtggacattttctgggataaaataagctttataaagaaagaacctggagacaactcaggaatgaacaaatcctgagacacattggatttccagcctttcagattgtgccatatctcctgactagaaaggcgagaggcctggctgaggccaacaacccacttgcattctgcatcccagatggggctttaagtgtcactgccctgcaggtggattagtctgtttctagacccaggaaggtgtaagggccgcctcgcgtgctttgggttctctttagtcatctagaagtgaacaagaggctataagaaggtcagaccaaaatgaggcctctccccagctctcagggatggtgggtctaatgctcattttcctgggggtgtgtccatccacttttgggcaagctgtacagaat

SEQ ID NO: 304485 - DNA, 429 bp, Homo sapiens
taggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggtggagccggcacctctggtctggattccacttaaaaccagttgagtggtctcaagcccttaacctctgtaagcctgtttcttctctgaaatcacagtaataaagcgtcgtaagatggttgggaagaacca

SEQ ID NO: 304486 - DNA, 863 bp, Homo sapiens
  misc_feature (448)..(450): n is a, c, g, or t
  misc_feature (452)..(452): n is a, c, g, or t
  misc_feature (455)..(455): n is a, c, g, or t
  misc_feature (491)..(491): n is a, c, g, or t
ctggaccagatgcaaacagtgcttttttggtgcccgtcacaaactcaatttttgttcgctcctttttggccttttccaatttgtccatctcaattttctgggccttggctaatgcctcatagtaggagtcctcagaccagccatggggatcaaacatatcctttgggtagttggtgccaagctcgtcaatggcacagaactggatcagcttctcgtagatgctagggttccgaaattctttcttcctttggataatgtagttcatatccattccctcctttatctttcgttcataaagcttctggatcttgtcttgcaagtgatttgaacatctgccagggggttctggcgggatcttgatttcatcaggcgacatgttccgaactctttcagaaaaggaggccacgagttcctggggtctcgctatctgcttctgtatatcctttgnnntncangtatgagaattgtgattcgtctactcgcccgtgctngagtgcctaacgagctggccatggaactttgtgagccctgggtgcctctgctcacctgtggcgacgacctcatcctttgggtacatcagcctacaggttcttcagtgcgtgatgaatgcgctacatctatgcacgactgtcgtacatgatatgagtcttcttcttagttcatgagccaatggtctacatcagcaccccctagaccgagatacaagttcattcctccccacaggcatcagataccgacaggccccactcggcacccgcagggcccaccgcgcacgagttccagacgcctgcgcacagcaggaccgtcgcggtcgtcctgaagtcccgacgcatcacgccgggacgagaggaacagcacaacca

SEQ ID NO: 304487 - DNA, 950 bp, Homo sapiens
  misc_feature (11)..(11): n is a, c, g, or t
  misc_feature (56)..(56): n is a, c, g, or t
  misc_feature (74)..(74): n is a, c, g, or t
  misc_feature (115)..(115): n is a, c, g, or t
ggggattcccngcctgtccaatgcccaagaggcatacacgggataccaccggtganttcttgggtcaacccctntgaacaagcgtcccaggcctccatcaccctgttgtcaaccntgaggcaatagtcccaaccaagactattgagtcttgggggacatgtgagctgaagcatttgcctgcaaacagaatgcaggagaggccagtgcatctgagatgccaagaggttaagaatacggcacttttaataggcggcagaccccaggtggtgcgtggacagaccctgtccacagcgcctggctcccgtgctgcctgtccttccatctggaatgccaaacagaagctcctctcaggtggcatctggggagtaggtcccagtcctgaaatatacaaagtggcgcctcccactgggcagtggtcactgggctgcacggtcctttcaagtcctagggtggcccctcaggtcactgcttggccttcttcacaatggtgcccacagcagagatgacggtggtcttggagccgctggcatgcccaggccccacagcccctctgcttggggtgagggaagcggtctggaggccgcagctgcttgaggatggtcaggccgagccagaagtgggaggagctggtgtcctgatgcccggctctgagactggtcacaaagggaacaaggcccagagataacagtttggtctcccagccaaactgatgctccctgaagaacccagaccacactgccagggaacaagtggtgctcagggccctaacgtgggacctaataggtagcacccaggcgagccactgagggcagctctggaggccaagacactcaccgagcagcgcaagctgggcctggcactctcttagggaactatttccctcccttcaggctacaaagggcccccatgacccaaaacggacaaagccccccaaggctctgcaattggcg

SEQ ID NO: 304488 - DNA, 2502 bp, Homo sapiens
taggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccagtttccagaagggctggggtgagatcctgacctgtgcagagagtggggaggcgtcagcgcctggccagggctgccccagtcctttggtgcccggtgagcgcagccagcaggagctgagcagcgggggagatgaatcacctcctgccttggcgaggcggcagctcattgtttacaggcaagccctgctcctgggagggctcctgccaccccacccttcctctgtgtgttatctctgccccacagcagcccctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacacactcgggcacttcaggaggtcagttctcaccccttcctcgatggggctttaaagctctggggagaagagctgctccccactcatgccccagagggactgtgaaaaggcttcctgtgacctccgatggcggcccctcattggccaagggcactgtggatgttttgtgggaggcagcatggcaccgtggaaagggcagtagacgtggagccggcacctctggtctggattccacttaaaaccagttgagtggtctcaagcccttaacctctgtaagcctgtttcttctctgaaatcacagtaataaagcgtcgtaagatggttgggaagaaccagaggtgacttatgcaaaagctttataaactgtaaagttcctgccagtg

SEQ ID NO: 304489 - DNA, 2117 bp, Homo sapiens
taggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccagtttccagaagggctggggtgagatcctgacctgtgcagagagtggggaggcgtcagcgcctggccagggctgccccagtcctttggtgcccggtgagcgcagccagcaggagctgagcagcgggggagatgaatcacctcctgccttggcgaggcggcagctcattgtttacaggcaagccctgctcctgggagggctcctgccaccccacccttcctctgtgtgttatctctgccccacagcagcccctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggaccgtggaaagggcagtagacgtggagccggcacctctggtctggattccacttaaaaccagttgagtggtctcaagcccttaacctctgtaagcctgtttcttctctgaaatcacagtaataaagcgtcgtaagatggttgggaagaacca

SEQ ID NO: 304490 - DNA, 1904 bp, Homo sapiens
taggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccagtttccagaagggctggggtgagatcctgacctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacac

SEQ ID NO: 304491 - DNA, 2411 bp, Homo sapiens
taggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaagcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccagtttccagaagggctggggtgagatcctgacctgtgcagagagtggggaggcgtcagcgcctggccagggctgccccagtcctttggtgcccggtgagcgcagccagcaggagctgagcagcgggggagatgaatcacctcctgccttggcgaggcggcagctcattgtttacaggcaagccctgctcctgggagggctcctgccaccccacccttcctctgtgtgttatctctgccccacagcagcccctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacacactcgggcacttcaggaggtcagttctcaccccttcctcgatggggctttaaagctctggggagaagagctgctccccactcatgccccagagggactgtgaaaaggcttcctgtgacctccgatggcggcccctcattggccaagggcactgtggatgttttgtgggaggcagcatggcaccgtggaaagggcagtagacgtggagccggcacctctggtctggattccacttaaaaccagttgagtggtctcaagcccttaacctctgtaagcctgtttcttctctgaaatcacagtaataaagcgtcgtaagatggttgggaagaacca

SEQ ID NO: 304492 - DNA, 2646 bp, Homo sapiens
agcctcctctttgcccacctgattggcagggggcagtggctcgaagagatgggttgctaagcagcctggcctggacgtggtgccctgccaggttgaatgaatagctgcagtgttctgaggaatggggaatttggcctgtcccagcatcaggagggactttctggaaagggggctaaaactgagtctaggttcagtgtggggaactgggtggccttcctggcaccttccttttggagccgtggcgtggtgtgccatgtctgtgtaagtggagcctgcggagctctgcacctgtcctcgaaaaggtcttgttgcagggtcttcctgtctcatctcctccctcactcatcagcaggaaaagacatggcgtccagcaactttctgtgaactctgcctctgctgttttgatgatgagcacgtgtggcccttgagattgttgatctaactggctttgaggggctgggtgtcagcaacccagaaatgggggaaacaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccagtttccagaagggctggggtgagatcctgacctgtgcagagagtggggaggcgtcagcgcctggccagggctgccccagtcctttggtgcccggtgagcgcagccagcaggagctgagcagcgggggagatgaatcacctcctgccttggcgaggcggcagctcattgtttacaggcaagccctgctcctgggagggctcctgccaccccacccttcctctgtgtgttatctctgccccacagcagcccctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacacactcgggcacttcaggaggtcagttctcaccccttcctcgatggggctttaaagctctggggagaagagctgctccccactcatgccccagagggactgtgaaaaggcttcctgtgacctccgatggcggcccctcattggccaagggcactgtggatgttttgtgggaggcagcatggcaccgtggaaagggcagtagacgtggagccggcacctctggtctggattccacttaaaaccagttgagtggtctcaagcccttaacctctgtaagcctgtttcttctctgaaatcacagtaataaagcgtcgtaagatggttgggaagaacca

SEQ ID NO: 304493 - DNA, 1131 bp, Homo sapiens
  misc_feature (11)..(11): n is a, c, g, or t
  misc_feature (56)..(56): n is a, c, g, or t
  misc_feature (74)..(74): n is a, c, g, or t
  misc_feature (115)..(115): n is a, c, g, or t
ggggattcccngcctgtccaatgcccaagaggcatacacgggataccaccggtganttcttgggtcaacccctntgaacaagcgtcccaggcctccatcaccctgttgtcaaccntgaggcaatagtcccaaccaagactattgagtcttgggggacatgtgagctgaagcatttgcctgcaaacagaatgcaggagaggccagtgcatctgagatgccaagaggttaagaatacggcacttttaataggcggcagaccccaggtggtgcgtggacagaccctgtccacagcgcctggctcccgtgctgcctgtccttccatctggaatgccaaacagaagctcctctcaggtggcatctggggagtaggtcccagtcctgaaatatacaaagtggcgcctcccactgggcagtggtcactgggctgcacggtcctttcaagtcctagggtggcccctcaggtcactgcttggccttcttcacaatggtgcccacagcagagatgacggtggtcttggagccgctggcgctggtggtgaccgtgacaacagctggcagggtggctgtggtggtgaggatggtgggctgggctatcgttgtcactgggatagccgaatcccacttgctctttctcttctgagcatctgcaacagctgtgctggcagtggtagtggtggtggacgtggcgttggtcgtggtgccttttttggtgcccgtcacaaactcaatttttgttcgctcctttttggccttttccaatttgtccatctcaattttctgggccttggctaatgcctcatagtaggagtcctcagaccagccatggggatcaaacatatcctttgggtagttggtgccaagctcgtcaatggcacagaactggatcagcttctcgtagatgctagggttccgaaattctttcttcctttggataatgtagttcatatccattccctcctttatctttcgttcataaagcttctggatcttgtcttgcaagtgatttgaacatctgccagggggttctggcgggatcttgatttcatcaggcgacactgcttctgtattatcctttgggtcatcagcctcaggtcagtctctgaatcgtcatcttccgactgtctactgttc

SEQ ID NO: 304494 - DNA, 1672 bp, Homo sapiens
aggggccaccctaggacttgaaaggaccgtgcagcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccagtttccagaagggctggggtgagatcctgacctgtgcagagagtggggaggcgtcagcgcctggccagggctgccccagtcctttggtgcccggtgagcgcagccagcaggagctgagcagcgggggagatgaatcacctcctgccttggcgaggcggcagctcattgtttacaggcaagccctgctcctgggagggctcctgccaccccacccttcctctgtgtgttatctctgccccacagcagcccctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacacactcgggcacttcaggaggtcagttctcaccccttcctcgatggggctttaaagctctggggagaagagctgctccccactcatgccccagagggactgtgaaaaggcttcctgtgacctccgatggcggcccctcattggccaagggcactgtggatgttttgtgggaggcagcatggcaccgtggaaagggcagtagacgtggagccggcacctctggtctggattccacttaaaaccagttgagtggtctcaagcccttaacctctgtaagcctgtttcttctctgaaatcacagtaataaagcgtcgtaagatggttgggaagaacca

SEQ ID NO: 304495 - DNA, 2283 bp, Homo sapiens
  misc_feature (11)..(11): n is a, c, g, or t
  misc_feature (56)..(56): n is a, c, g, or t
  misc_feature (74)..(74): n is a, c, g, or t
  misc_feature (115)..(115): n is a, c, g, or t
  misc_feature (1868)..(1870): n is a, c, g, or t
  misc_feature (1872)..(1872): n is a, c, g, or t
  misc_feature (1875)..(1875): n is a, c, g, or t
  misc_feature (1911)..(1911): n is a, c, g, or t
ggggattcccngcctgtccaatgcccaagaggcatacacgggataccaccggtganttcttgggtcaacccctntgaacaagcgtcccaggcctccatcaccctgttgtcaaccntgaggcaatagtcccaaccaagactattgagtcttgggggacatgtgagctgaagcatttgcctgcaaacagaatgcaggagaggccagtgcatctgagatgccaagaggttaagaatacggcacttttaataggcggcagaccccaggtggtgcgtggacagaccctgtccacagcgcctggctcccgtgctgcctgtccttccatctggaatgccaaacagaagctcctctcaggtggcatctggggagtaggtcccagtcctgaaatatacaaagtggcgcctcccactgggcagtggtcactgggctgcacggtcctttcaagtcctagggtggcccctcaggtcactgcttggccttcttcacaatggtgcccacagcagagatgacggtggtcttggagccgctggcgctggtggtgaccgtgacaacagctggcagggtggctgtggtggtgaggatggtgggctgggctatcgttgtcactgggatagccgaatcccacttgctctttctcttctgagcatctgcaacagctgtgctggcagtggtagtggtggtggacgtggcgttggtcgtggtgccttttttggtgcccgtcacaaactcaatttttgttcgctcctttttggccttttccaatttgtccatctcaattttctgggccttggctaatgcctcatagtaggagtcctcagaccagccatggggatcaaacatatcctttgggtagttggtgccaagctcgtcaatggcacagaactggatcagcttctcgtagatgctgaaagaacagtgccggcgctgagcaggcacaagtccacgtccctgcatgggacctgaaccatccagctcctggggctgacacaaaaccttcacaacttttaaatccagctcagctgctctaagcaagcttcctgatggccctccactctcccagggagatggacctgttagctaggggccgggaggagcacagggtcaaggtgacggctgagttttgtctcactgaccttcagtctgcacagctggattgggcttaccacactcagacccacacaagggccatgctcttttccctgtatgtcactagcttgaacattcaatggaggaagaccagacatcgctctggtcctaagacctctcacctatatgcaaaaatcagctttttttgagttggaagatgaacctacagtaattgtctagtccaattccttccatgaggacaggggacttgagaggtcatgtgctttaggctcagagcagggacgagaactcagccaggtctccctcatccccgtctaggtctcggtatgaattgctttgtgttttttctggatcttaaatggcaagcctctggctgggttagcacagtccgccatgtccagcaggcactcagtgtaatgacaagtctgggtgatggtttgggctctgggcttttcctcaccacctccttggggacgtcttagtccttagtccaacattaataactcaataaactctgcaggctcaagggaaacttacctagggttccgaaattctttcttcctttggataatgtagttcatatccattccctcctttatctttcgttcataaagcttctggatcttgtcttgcaagtgatttgaacatctgccagggggttctggcgggatcttgatttcatcaggcgacatgttccgaactctttcagaaaaggaggccacgagttcctggggtctcgctatctgcttctgtatatcctttgnnntncangtatgagaattgtgattcgtctactcgcccgtgctngagtgcctaacgagctggccatggaactttgtgagccctgggtgcctctgctcacctgtggcgacgacctcatcctttgggtacatcagcctacaggttcttcagtgcgtgatgaatgcgctacatctatgcacgactgtcgtacatgatatgagtcttcttcttagttcatgagccaatggtctacatcagcaccccctagaccgagatacaagttcattcctccccacaggcatcagataccgacaggccccactcggcacccgcagggcccaccgcgcacgagttccagacgcctgcgcacagcaggaccgtcgcggtcgtcctgaagtcccgacgcatcacgccgggacgagaggaacagcacaacca

SEQ ID NO: 304496 - DNA, 2612 bp, Homo sapiens
  misc_feature (11)..(11): n is a, c, g, or t
  misc_feature (56)..(56): n is a, c, g, or t
  misc_feature (74)..(74): n is a, c, g, or t
  misc_feature (115)..(115): n is a, c, g, or t
  misc_feature (1081)..(1082): n is a, c, g, or t
  misc_feature (1084)..(1084): n is a, c, g, or t
  misc_feature (1087)..(1087): n is a, c, g, or t
  misc_feature (1090)..(1094): n is a, c, g, or t
  misc_feature (1098)..(1098): n is a, c, g, or t
  misc_feature (1103)..(1103): n is a, c, g, or t
  misc_feature (1109)..(1109): n is a, c, g, or t
  misc_feature (2197)..(2199): n is a, c, g, or t
  misc_feature (2201)..(2201): n is a, c, g, or t
  misc_feature (2204)..(2204): n is a, c, g, or t
  misc_feature (2240)..(2240): n is a, c, g, or t
ggggattcccngcctgtccaatgcccaagaggcatacacgggataccaccggtganttcttgggtcaacccctntgaacaagcgtcccaggcctccatcaccctgttgtcaaccntgaggcaatagtcccaaccaagactattgagtcttgggggacatgtgagctgaagcatttgcctgcaaacagaatgcaggagaggccagtgcatctgagatgccaagaggttaagaatacggcacttttaataggcggcagaccccaggtggtgcgtggacagaccctgtccacagcgcctggctcccgtgctgcctgtccttccatctggaatgccaaacagaagctcctctcaggtggcatctggggagtaggtcccagtcctgaaatatacaaagtggcgcctcccactgggcagtggtcactgggctgcacggtcctttcaagtcctagggtggcccctcaggtcactgcttggccttcttcacaatggtgcccacagcagagatgacggtggtcttggagccgctggcgctggtggtgaccgtgacaacagctggcagggtggctgtggtggtgaggatggtgggctgggctatcgttgtcactgggatagccgaatcccacttgctctttctcttctgagcatctgcaacagctgtgctggcagtggtagtggtggtggacgtggcgttggtcgtggtgccttttttggtgcccgtcacaaactcaatttttgttcgctcctttttggccttttccaatttgtccatctcaattttctgggccttggctaatgcctcatagtaggagtcctcagaccagccatggggatcaaacatatcccggggctcggctgtcatctttggtcttttacccaaggggcggctcgcaagtgctgaagaacatgggagcacgaagcccccatccagcggaccccaggagcagcaggtccacacatgtccccaccaatcaggggccaggcaccaggccggccaccggaatctctttagtggactatttcagaacaatagggactccaaccaaagagacagggactgtgctttcaacgatccgtgccaccanntnganctnnnnntggntgagntcaatnccatggaacagcaaaggacctgggtgtcccatcaccctccagcccgtgtgccagacgcacctttgggtagttggtgccaagctcgtcaatggcacagaactggatcagcttctcgtagatgctgaaagaacagtgccggcgctgagcaggcacaagtccacgtccctgcatgggacctgaaccatccagctcctggggctgacacaaaaccttcacaacttttaaatccagctcagctgctctaagcaagcttcctgatggccctccactctcccagggagatggacctgttagctaggggccgggaggagcacagggtcaaggtgacggctgagttttgtctcactgaccttcagtctgcacagctggattgggcttaccacactcagacccacacaagggccatgctcttttccctgtatgtcactagcttgaacattcaatggaggaagaccagacatcgctctggtcctaagacctctcacctatatgcaaaaatcagctttttttgagttggaagatgaacctacagtaattgtctagtccaattccttccatgaggacaggggacttgagaggtcatgtgctttaggctcagagcagggacgagaactcagccaggtctccctcatccccgtctaggtctcggtatgaattgctttgtgttttttctggatcttaaatggcaagcctctggctgggttagcacagtccgccatgtccagcaggcactcagtgtaatgacaagtctgggtgatggtttgggctctgggcttttcctcaccacctccttggggacgtcttagtccttagtccaacattaataactcaataaactctgcaggctcaagggaaacttacctagggttccgaaattctttcttcctttggataatgtagttcatatccattccctcctttatctttcgttcataaagcttctggatcttgtcttgcaagtgatttgaacatctgccagggggttctggcgggatcttgatttcatcaggcgacatgttccgaactctttcagaaaaggaggccacgagttcctggggtctcgctatctgcttctgtatatcctttgnnntncangtatgagaattgtgattcgtctactcgcccgtgctngagtgcctaacgagctggccatggaactttgtgagccctgggtgcctctgctcacctgtggcgacgacctcatcctttgggtacatcagcctacaggttcttcagtgcgtgatgaatgcgctacatctatgcacgactgtcgtacatgatatgagtcttcttcttagttcatgagccaatggtctacatcagcaccccctagaccgagatacaagttcattcctccccacaggcatcagataccgacaggccccactcggcacccgcagggcccaccgcgcacgagttccagacgcctgcgcacagcaggaccgtcgcggtcgtcctgaagtcccgacgcatcacgccgggacgagaggaacagcacaacca

SEQ ID NO: 304497 - DNA, 3008 bp, Homo sapiens
  misc_feature (11)..(11): n is a, c, g, or t
  misc_feature (56)..(56): n is a, c, g, or t
  misc_feature (74)..(74): n is a, c, g, or t
  misc_feature (115)..(115): n is a, c, g, or t
  misc_feature (1056)..(1056): n is a, c, g, or t
  misc_feature (1477)..(1478): n is a, c, g, or t
  misc_feature (1480)..(1480): n is a, c, g, or t
  misc_feature (1483)..(1483): n is a, c, g, or t
  misc_feature (1486)..(1490): n is a, c, g, or t
  misc_feature (1494)..(1494): n is a, c, g, or t
  misc_feature (1499)..(1499): n is a, c, g, or t
  misc_feature (1505)..(1505): n is a, c, g, or t
  misc_feature (2593)..(2595): n is a, c, g, or t
  misc_feature (2597)..(2597): n is a, c, g, or t
  misc_feature (2600)..(2600): n is a, c, g, or t
  misc_feature (2636)..(2636): n is a, c, g, or t
ggggattcccngcctgtccaatgcccaagaggcatacacgggataccaccggtganttcttgggtcaacccctntgaacaagcgtcccaggcctccatcaccctgttgtcaaccntgaggcaatagtcccaaccaagactattgagtcttgggggacatgtgagctgaagcatttgcctgcaaacagaatgcaggagaggccagtgcatctgagatgccaagaggttaagaatacggcacttttaataggcggcagaccccaggtggtgcgtggacagaccctgtccacagcgcctggctcccgtgctgcctgtccttccatctggaatgccaaacagaagctcctctcaggtggcatctggggagtaggtcccagtcctgaaatatacaaagtggcgcctcccactgggcagtggtcactgggctgcacggtcctttcaagtcctagggtggcccctcaggtcactgcttggccttcttcacaatggtgcccacagcagagatgacggtggtcttggagccgctggcgctggtggtgaccgtgacaacagctggcagggtggctgtggtggtgaggatggtgggctgggctatcgttgtcactgggatagccgaatcccacttgctctttctcttctgagcatctgcaacagctgtgctggcagtggtagtggtggtggacgtggcgttggtcgtggtgccttttttggtgcccgtcacaaactcaatctggagagggagagggaagagaataagaccaggcaaagctgggtgtccacagctttttgccatccgtcagctcctgggggacaggagcttggcactacacaaaagaggcattggaaatgaactctgctctgcccatctggggtagggcgagatgtctaagaagaacccaaaggggcttttcactcttaaaagaactttccaaacagtactgtatccctcccggcatcaccaggtctctgcacatgcccggcaccccccgcccaccgccccacctcacatgcccagaaccgtttggccaggcccctcctcctcacacccaggaggagncggtgccgcccgcacaggggaaggacagctccggtccccaggcgctgcagacacgtccctgcaacaagcttttgttcgctcctttttggccttttccaatttgtccatctcaattttctgggccttggctaatgcctcatagtaggagtcctcagaccagccatggggatcaaacatatcccggggctcggctgtcatctttggtcttttacccaaggggcggctcgcaagtgctgaagaacatgggagcacgaagcccccatccagcggaccccaggagcagcaggtccacacatgtccccaccaatcaggggccaggcaccaggccggccaccggaatctctttagtggactatttcagaacaatagggactccaaccaaagagacagggactgtgctttcaacgatccgtgccaccanntnganctnnnnntggntgagntcaatnccatggaacagcaaaggacctgggtgtcccatcaccctccagcccgtgtgccagacgcacctttgggtagttggtgccaagctcgtcaatggcacagaactggatcagcttctcgtagatgctgaaagaacagtgccggcgctgagcaggcacaagtccacgtccctgcatgggacctgaaccatccagctcctggggctgacacaaaaccttcacaacttttaaatccagctcagctgctctaagcaagcttcctgatggccctccactctcccagggagatggacctgttagctaggggccgggaggagcacagggtcaaggtgacggctgagttttgtctcactgaccttcagtctgcacagctggattgggcttaccacactcagacccacacaagggccatgctcttttccctgtatgtcactagcttgaacattcaatggaggaagaccagacatcgctctggtcctaagacctctcacctatatgcaaaaatcagctttttttgagttggaagatgaacctacagtaattgtctagtccaattccttccatgaggacaggggacttgagaggtcatgtgctttaggctcagagcagggacgagaactcagccaggtctccctcatccccgtctaggtctcggtatgaattgctttgtgttttttctggatcttaaatggcaagcctctggctgggttagcacagtccgccatgtccagcaggcactcagtgtaatgacaagtctgggtgatggtttgggctctgggcttttcctcaccacctccttggggacgtcttagtccttagtccaacattaataactcaataaactctgcaggctcaagggaaacttacctagggttccgaaattctttcttcctttggataatgtagttcatatccattccctcctttatctttcgttcataaagcttctggatcttgtcttgcaagtgatttgaacatctgccagggggttctggcgggatcttgatttcatcaggcgacatgttccgaactctttcagaaaaggaggccacgagttcctggggtctcgctatctgcttctgtatatcctttgnnntncangtatgagaattgtgattcgtctactcgcccgtgctngagtgcctaacgagctggccatggaactttgtgagccctgggtgcctctgctcacctgtggcgacgacctcatcctttgggtacatcagcctacaggttcttcagtgcgtgatgaatgcgctacatctatgcacgactgtcgtacatgatatgagtcttcttcttagttcatgagccaatggtctacatcagcaccccctagaccgagatacaagttcattcctccccacaggcatcagataccgacaggccccactcggcacccgcagggcccaccgcgcacgagttccagacgcctgcgcacagcaggaccgtcgcggtcgtcctgaagtcccgacgcatcacgccgggacgagaggaacagcacaacca

SEQ ID NO: 304498 - DNA, 1107 bp, Homo sapiens
  misc_feature (11)..(11): n is a, c, g, or t
  misc_feature (56)..(56): n is a, c, g, or t
  misc_feature (74)..(74): n is a, c, g, or t
  misc_feature (115)..(115): n is a, c, g, or t
ggggattcccngcctgtccaatgcccaagaggcatacacgggataccaccggtganttcttgggtcaacccctntgaacaagcgtcccaggcctccatcaccctgttgtcaaccntgaggcaatagtcccaaccaagactattgagtcttgggggacatgtgagctgaagcatttgcctgcaaacagaatgcaggagaggccagtgcatctgagatgccaagaggttaagaatacggcacttttaataggcggcagaccccaggtggtgcgtggacagaccctgtccacagcgcctggctcccgtgctgcctgtccttccatctggaatgccaaacagaagctcctctcaggtggcatctggggagtaggtcccagtcctgaaatatacaaagtggcgcctcccactgggcagtggtcactgggctgcacggtcctttcaagtcctagggtggcccctcaggtcactgcttggccttcttcacaatggtgcccacagcagagatgacggtggtcttggagccgctggcgctggtggtgaccgtgacaacagctggcagggtggctgtggtggtgaggatggtgggctgggctatcgttgtcactgggatagccgaatcccacttgctctttctcttctgagcatctgcaacagctgtgctggcagtggtagtggtggtggacgtggcgttggtcgtggtgccttttttggtgcccgtcacaaactcaatttttgttcgctcctttttggccttttccaatttgtccatctcaattttctgggccttggctatgaagacaagagaagctgttacaaaggtggcccccgagcagctctgggctgagggagcctactctgatccctgcgttcttttcagcgggctaaaggccttcatgggctcagtgttctttgtgcttggcaaaatgaagccagcccttggtcggcatagggcaggggccttcagctccagactggcgggctgcatgccctgtgtgtgcccggaagggtcagctactcctgagctcctgtggactgccaacacacgggatacaggccttatgggtaacaaggatactcaggaacagactatgaagaaatcacgtcacga

SEQ ID NO: 304499 - DNA, 1682 bp, Homo sapiens
  misc_feature (11)..(11): n is a, c, g, or t
  misc_feature (56)..(56): n is a, c, g, or t
  misc_feature (74)..(74): n is a, c, g, or t
  misc_feature (115)..(115): n is a, c, g, or t
  misc_feature (1056)..(1056): n is a, c, g, or t
ggggattcccngcctgtccaatgcccaagaggcatacacgggataccaccggtganttcttgggtcaacccctntgaacaagcgtcccaggcctccatcaccctgttgtcaaccntgaggcaatagtcccaaccaagactattgagtcttgggggacatgtgagctgaagcatttgcctgcaaacagaatgcaggagaggccagtgcatctgagatgccaagaggttaagaatacggcacttttaataggcggcagaccccaggtggtgcgtggacagaccctgtccacagcgcctggctcccgtgctgcctgtccttccatctggaatgccaaacagaagctcctctcaggtggcatctggggagtaggtcccagtcctgaaatatacaaagtggcgcctcccactgggcagtggtcactgggctgcacggtcctttcaagtcctagggtggcccctcaggtcactgcttggccttcttcacaatggtgcccacagcagagatgacggtggtcttggagccgctggcgctggtggtgaccgtgacaacagctggcagggtggctgtggtggtgaggatggtgggctgggctatcgttgtcactgggatagccgaatcccacttgctctttctcttctgagcatctgcaacagctgtgctggcagtggtagtggtggtggacgtggcgttggtcgtggtgccttttttggtgcccgtcacaaactcaatctggagagggagagggaagagaataagaccaggcaaagctgggtgtccacagctttttgccatccgtcagctcctgggggacaggagcttggcactacacaaaagaggcattggaaatgaactctgctctgcccatctggggtagggcgagatgtctaagaagaacccaaaggggcttttcactcttaaaagaactttccaaacagtactgtatccctcccggcatcaccaggtctctgcacatgcccggcaccccccgcccaccgccccacctcacatgcccagaaccgtttggccaggcccctcctcctcacacccaggaggagncggtgccgcccgcacaggggaaggacagctccggtccccaggcgctgcagacacgtccctgcaacaagcctggggtttggaagggagagggaaagagagagaagggagattcaatcaagggttaagaatgagaaaccccaactatccccttgcaccagctcccacgttcctggcccagcagccagcacctccagagggccaccaatgcccaggccccacagcccctctgcttggggtgagggaagcggtctggaggccgcagctgcttgaggatggtcaggccgagccagaagtgggaggagctggtgtcctgatgcccggctctgagactggtcacaaagggaacaaggcccagagataacagtttggtctcccagccaaactgatgctccctgaagaacccagaccacactgccagggaacaagtggtgctcagggccctaacgtgggacctaataggtagcacccaggcgagccactgagggcagctctggaggccaagacactcaccgagcagcgcaagctgggcctggcactctcttagggaactatttccctcccttcaggctacaaagggcccccatgacccaaaacggacaaagccccccaaggctctgcaattggcg

SEQ ID NO: 304500 - DNA, 1282 bp, Homo sapiens
  misc_feature (628)..(628): n is a, c, g, or t
  misc_feature (867)..(869): n is a, c, g, or t
  misc_feature (871)..(871): n is a, c, g, or t
  misc_feature (874)..(874): n is a, c, g, or t
  misc_feature (910)..(910): n is a, c, g, or t
taggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaagatatgtttgatccacatgctggtttgacgcacagaactggatcancttctcgtaatgctagggttccgaaattctttcttcctttggataatgtagttcatatccattccctcctttatctttcgttcataaagcttctggatcttgtcttgcaagtgatttgaacatctgccagggggttctggcgggatcttgatttcatcaggcgacatgttccgaactctttcagaaaaggaggccacgagttcctggggtctcgctatctgcttctgtatatcctttgnnntncangtatgagaattgtgattcgtctactcgcccgtgctngagtgcctaacgagctggccatggaactttgtgagccctgggtgcctctgctcacctgtggcgacgacctcatcctttgggtacatcagcctacaggttcttcagtgcgtgatgaatgcgctacatctatgcacgactgtcgtacatgatatgagtcttcttcttagttcatgagccaatggtctacatcagcaccccctagaccgagatacaagttcattcctccccacaggcatcagataccgacaggccccactcggcacccgcagggcccaccgcgcacgagttccagacgcctgcgcacagcaggaccgtcgcggtcgtcctgaagtcccgacgcatcacgccgggacgagaggaacagcacaacca

SEQ ID NO: 304501 - DNA, 1607 bp, Homo sapiens
  misc_feature (11)..(11): n is a, c, g, or t
  misc_feature (56)..(56): n is a, c, g, or t
  misc_feature (74)..(74): n is a, c, g, or t
  misc_feature (115)..(115): n is a, c, g, or t
  misc_feature (1192)..(1194): n is a, c, g, or t
  misc_feature (1196)..(1196): n is a, c, g, or t
  misc_feature (1199)..(1199): n is a, c, g, or t
  misc_feature (1235)..(1235): n is a, c, g, or t
ggggattcccngcctgtccaatgcccaagaggcatacacgggataccaccggtganttcttgggtcaacccctntgaacaagcgtcccaggcctccatcaccctgttgtcaaccntgaggcaatagtcccaaccaagactattgagtcttgggggacatgtgagctgaagcatttgcctgcaaacagaatgcaggagaggccagtgcatctgagatgccaagaggttaagaatacggcacttttaataggcggcagaccccaggtggtgcgtggacagaccctgtccacagcgcctggctcccgtgctgcctgtccttccatctggaatgccaaacagaagctcctctcaggtggcatctggggagtaggtcccagtcctgaaatatacaaagtggcgcctcccactgggcagtggtcagggtcaaggtgacggctgagttttgtctcactgaccttcagtctgcacagctggattgggcttaccacactcagacccacacaagggccatgctcttttccctgtatgtcactagcttgaacattcaatggaggaagaccagacatcgctctggtcctaagacctctcacctatatgcaaaaatcagctttttttgagttggaagatgaacctacagtaattgtctagtccaattccttccatgaggacaggggacttgagaggtcatgtgctttaggctcagagcagggacgagaactcagccaggtctccctcatccccgtctaggtctcggtatgaattgctttgtgttttttctggatcttaaatggcaagcctctggctgggttagcacagtccgccatgtccagcaggcactcagtgtaatgacaagtctgggtgatggtttgggctctgggcttttcctcaccacctccttggggacgtcttagtccttagtccaacattaataactcaataaactctgcaggctcaagggaaacttacctagggttccgaaattctttcttcctttggataatgtagttcatatccattccctcctttatctttcgttcataaagcttctggatcttgtcttgcaagtgatttgaacatctgccagggggttctggcgggatcttgatttcatcaggcgacatgttccgaactctttcagaaaaggaggccacgagttcctggggtctcgctatctgcttctgtatatcctttgnnntncangtatgagaattgtgattcgtctactcgcccgtgctngagtgcctaacgagctggccatggaactttgtgagccctgggtgcctctgctcacctgtggcgacgacctcatcctttgggtacatcagcctacaggttcttcagtgcgtgatgaatgcgctacatctatgcacgactgtcgtacatgatatgagtcttcttcttagttcatgagccaatggtctacatcagcaccccctagaccgagatacaagttcattcctccccacaggcatcagataccgacaggccccactcggcacccgcagggcccaccgcgcacgagttccagacgcctgcgcacagcaggaccgtcgcggtcgtcctgaagtcccgacgcatcacgccgggacgagaggaacagcacaacca

SEQ ID NO: 304502 - DNA, 915 bp, Homo sapiens
  misc_feature (500)..(502): n is a, c, g, or t
  misc_feature (504)..(504): n is a, c, g, or t
  misc_feature (507)..(507): n is a, c, g, or t
  misc_feature (543)..(543): n is a, c, g, or t
taggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggttcataaagcttctggatcttgtcttgcaagtgatttgaacatctgccagggggttctggcgggatcttgatttcatcaggcgacatgttccgaactctttcagaaaaggaggccacgagttcctggggtctcgctatctgcttctgtatatcctttgnnntncangtatgagaattgtgattcgtctactcgcccgtgctngagtgcctaacgagctggccatggaactttgtgagccctgggtgcctctgctcacctgtggcgacgacctcatcctttgggtacatcagcctacaggttcttcagtgcgtgatgaatgcgctacatctatgcacgactgtcgtacatgatatgagtcttcttcttagttcatgagccaatggtctacatcagcaccccctagaccgagatacaagttcattcctccccacaggcatcagataccgacaggccccactcggcacccgcagggcccaccgcgcacgagttccagacgcctgcgcacagcaggaccgtcgcggtcgtcctgaagtcccgacgcatcacgccgggacgagaggaacagcacaacca

SEQ ID NO: 304503 - DNA, 457 bp, Homo sapiens
tctgatggcgaggctggaatcgaggcggtgggcagcgcggctggtaaggcccaagtgcgaagctggaagggggaatcgggtgtctgcccggaatgctgtaccctcgctgggcgggagggaacaagatggtcattgtgctccaagcaccggaccccgaagaatggtccagggtccggggtgagatagagcattagagactgtggactaagaatgaagaatctccttcccgttatttcgattaatttgcctaaacttactgaaagactccgtgccggctatagtgatagacagagggatggacgaagagggagcggctgctcagccactgcctgtttcccctgggctcgttgtttgatgagggagagcgataagtaaaacatacgtggaagatggtaaagattgtgttcgttaactttataacttttagttaggaatgtgccctaaacacatcttggag

SEQ ID NO: 304504 - DNA, 726 bp, Homo sapiens
ggagcctgcggagctctgcacctgtcctcgaaaaggtcttgttgcagggtcttcctgtctcatctcctccctcactcatcagcaggaaaagacatggcgtccagcaactttctgtgaactctgcctctgctgttttgatgatgagcacgtgtggcccttgagattgttgatctaactggctttgaggggctgggtgtcagcaacccagaaatgggggaaacaggtgtgttcttgccattttacacttgagacaatggaggcaagggaagacttgtgacggagggcttggaccgtggctttctcagcattgattttggtttagatgaaacatttactacagaacagtgaaatccagaaaacgtctaagaagcctttgctctcaggtttctgcaggacatgtggatgtagctgtcatgggacactgtttgcattagggattggaggaagcttttctttggagggagtataaagccagtgtaaagggagctgagagccagagagaggcttccttgagcctggggcctctctgggatccccattctgccacttattaaaggtttgctgcatgcttgctctgaggttccatgagctgcccctttatcctcatgatgaagcctcccttctttgaactaaaaataagaagagtatcttgggagcagctagtctgcattttcatctcgggagtctgctgttacaaagcagtcacctcttgcttccttggtacca

SEQ ID NO: 304505 - DNA, 318 bp, Homo sapiens
ggggagggattcttggtgggatgaccccagctgggtaaatgggctgtttgctccggcccctagttatgcatgtgagactcctcaggcccgctcctttaagcttaatcctctaaattctttgtcttgtaggaagatgacgattcagagactgaaaaacctgaggctgatgacccaaaggtatttggtgttggctgtggtgggtggctggatgcaaacaaggtgtttgaacactgtggctcagttcgtatgtttggtcaagatctgtcccactgacaaactgtgcaactgtgtggacattttctgggataaaataagctt

SEQ ID NO: 304506 - DNA, 621 bp, Homo sapiens
gtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacttctgtgatctgcttccttcctttccagattatgcggatcaaacctcaccaaggccagcacataggagagatgagcttcctacagcacaacaaatgtgaatgcaggtgaggatgtagtcacggattcattatcagcaagtggctgcagggtgcctgatctgtgccagggttaagcatgctgtactttttggcccccgtccagcttcccgctatgtgacctttggcattttacttcaatgtgcctcagtttctacatctgtaaaatgggcacaatagtagtatacttcatagcattgttataatgattaaacaagttatatatgaaaaga

SEQ ID NO: 304507 - DNA, 2517 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatacaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaa

SEQ ID NO: 304508 - DNA, 2275 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaa

SEQ ID NO: 304509 - DNA, 2503 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 304510 - DNA, 2589 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgttccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatacaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaa

SEQ ID NO: 304511 - DNA, 2571 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccgtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatacaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaa

SEQ ID NO: 304512 - DNA, 3222 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaaaaaaaaaaaaaaaaaaaaaaaaaaaaaaaaaaaaaaagaaaaaagaagaaaaaaaaaaaaaaaaaaaaaaaaaaaaaaaaaaatcgaaagaaaaaagcaaaaaagaaaacaaagaagacaacaaaaaaataaaaagaaagaaaacaacaaaggaaccgagggagcggcggaccaatcacaagcaactcgtgacgacacgcgacgcgcagacacacgagacaccagccactctgctgccactcaagcactaacactacatcagaaaagataaaaaaccgaaccaacgacacgaaccgagacccataataaacaaaaacacacaagagaagaacgaagacacaacaacgaacaatagcaccacgaactacacaagacgaaagaacacacatcgaaaacgaacatgacggagggacacagagcaggaacacagaccgcaacgcgcgaccacagaagaagaacacaacactcactagcatctgagaaggaaacagcaagcaccaacacaagtatagagcaacaccgttggaattggaaagcaaccaaaactataaacaaaacaacagacgcagacatcacaagtaaccaagcagaccaaggaaggccataacacaaggatcaaaagaaaagaaaacaacaaccaccacgcaacacaccaaataaagaaaaaccaaaaaaaaacgcaaaagagaagaaataaaaccaca

SEQ ID NO: 304513 - DNA, 2640 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtgtacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatacaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaa

SEQ ID NO: 304514 - DNA, 2466 bp, Homo sapiens
gtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacttctgtgatctgcttccttcctttccagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatacaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaa

SEQ ID NO: 304515 - DNA, 2101 bp, Homo sapiens
acgcgtgggcggacgcgtgggtgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatacaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaa

SEQ ID NO: 304516 - DNA, 2385 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatacaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaa

SEQ ID NO: 304517 - DNA, 2837 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaaaaaaaaaaaaaaaaaagggggggggggcaaaaaaaaatcccccgggggggccacaaagattaaagaagcataaccacccacagttgttctttggcaacaaacgggggcccccaaataggggacaggccacgataaataaagaaccaaagagacgagggccacgcaaaccatcaaccaggcgcggccgggagaacaaatgcccacatcgtggacactgtcggagagaacccaaacgcgtggggggcaacaaagggaacaaacacaccaagaaaaaacaaacgccaggcaaaaaaagtaaacacgcaaggccccaagggca

SEQ ID NO: 304518 - DNA, 2482 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatacaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaa

SEQ ID NO: 304519 - DNA, 2994 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaaaaaaaaaaaaaaaaaaaaaaaaaaaaaaaaaaaaaaaaaaaaaaaaaaaaaagaaaaaagaagaaaaaaaaaaaaaaaaaaaaaaaaaaaaaaaaaaatcgaaagaaaaaagcaaaaaagaaaacaaagaagacaacaaaaaaataaaaagaaagaaaacaacaaaggaaccgagggagcggcggaccaatcacaagcaactcgtgacgacacgcgacgcgcagacacacgagacaccagccactctgctgccactcaagcactaacactacatcagaaaagataaaaaaccgaaccaacgacacgaaccgagacccataataaacaaaaacacacaagagaagaacgaagacacaacaacgaacaatagcaccacgaactacacaagacgaaagaacacacatcgaaaacgaacatgacggagggacacagagcaggaacacagaccgcaacgcgcgaccacagaagaagaacacaacactcactagcatctgagaaggaaacagcaagcaccaacacaagtatagagcaacaccgttggaattggaaagcaaccaaaactataaacaaaacaacagacgcagacatcacaagtaaccaagcagaccaaggaaggccataacacaaggatcaaaagaaaagaaaacaacaaccaccacgcaacacaccaaataaagaaaaaccaaaaaaaaacgcaaaagagaagaaataaaaccaca

SEQ ID NO: 304520 - DNA, 2483 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 304521 - DNA, 2448 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 304522 - DNA, 1555 bp, Homo sapiens
gtgcatgtcggagcaccacggtgtgtgcatgtaacacacacacaggtccatgaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaa

SEQ ID NO: 304523 - DNA, 2446 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 304524 - DNA, 2222 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaa

SEQ ID NO: 304525 - DNA, 2102 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggcattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaa

SEQ ID NO: 304526 - DNA, 1544 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatatactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgccggacagaaggccattgactaagtgcccgcgaagagaagaaacacaatggtggaagaagacccatgtgagagttccttgctgtgacactggctcctcttcctgtgaccctttctgtgg

SEQ ID NO: 304527 - DNA, 832 bp, Homo sapiens
ccttcccgaggcacagagagacaggtaagggaaggaccagtggatggaggaaggtcaaccactcacacacacacaaccaggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaa

SEQ ID NO: 304528 - DNA, 1059 bp, Homo sapiens
tcctttgaaataggtcaatcatatgctgtatatttatttttatttataatagtattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaaaaaaaaaaaaaaaaaaaaaaaaaaaaaaaaaaaaaaagaaaaaagaagaaaaaaaaaaaaaaaaaaaaaaaaaaaaaaaaaaatcgaaagaaaaaagcaaaaaagaaaacaaagaagacaacaaaaaaataaaaagaaagaaaacaacaaaggaaccgagggagcggcggaccaatcacaagcaactcgtgacgacacgcgacgcgcagacacacgagacaccagccactctgctgccactcaagcactaacactacatcagaaaagataaaaaaccgaaccaacgacacgaaccgagacccataataaacaaaaacacacaagagaagaacgaagacacaacaacgaacaatagcaccacgaactacacaagacgaaagaacacacatcgaaaacgaacatgacggagggacacagagcaggaacacagaccgcaacgcgcgaccacagaagaagaacacaacactcactagcatctgagaaggaaacagcaagcaccaacacaagtatagagcaacaccgttggaattggaaagcaaccaaaactataaacaaaacaacagacgcagacatcacaagtaaccaagcagaccaaggaaggccataacacaaggatcaaaagaaaagaaaacaacaaccaccacgcaacacaccaaataaagaaaaaccaaaaaaaaacgcaaaagagaagaaataaaaccaca

SEQ ID NO: 304529 - DNA, 1012 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaagtaagtggccctgactttagcacttctccctctccatggccggttgtcttggtttggggctcttggctacctctgttgggggctcccatagcctccctgggtcagggacttggtcttgtgggggacttgtggtggcagcaacaatgggatggagccaactccaggatgatggctctagggctagtgagaaaacatagccaggagcctggcacttcctttggaagggacaatgccttctgggtctccagatcattcctgaccaggacttgctgtttcggtgtgtcagggggcactgtggacactggctcactggcttgctctaggacacccacagtggggagagggagtgggtggcagagaggccagcttttgtgtgtcagaggaaatggcctcttttggtggctgctgtgacggtgcagttggatgcgaggccggctggagggtggtttctcagtgcatgccctcctgtaggcggcaggcggcagacacacagccctcttggccagggagaaaaagttgaatgttggtcattt

SEQ ID NO: 304530 - DNA, 841 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(18): n is a, c, g, or t
cagngngcnggngnnnnngcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaaagaggccaagcacattgcggaagaggctgaccgcaaatacgaggaggtagctcgtaagctggtcactcctggagggtgatgcttggagagggcagaggagcgtgcggaggtgtctgaactaaaatgtggtgacctggtaagaagaactcaagaatgttactaacaattctgaaatctctggaggctgcatctgaaaagtattctgaaacggaggacacacactatgaacgaagaaattaccttctgactgacaaactgaaagaggctgagacccgtgctgaatttgcgagagaacggtgaaaactggaaaagactattgatgaccttggaagagaatctttgccaggcaacggaagagaacgtgggcttccatcagacactggatcagacctaaagggaactgaactgtatataagcaaaacagaagagtctgtccacagaaattctgg

SEQ ID NO: 304531 - DNA, 508 bp, Homo sapiens
atgaaatttggacattcagttctagcaccttatttgacatacttcccactcttagattctcttaaacttatatttctgattttgttttttttcttatagatatttatccccattttacaaggcctggctcttgctgccaaagagtgctccctcgacagtgactactttaaataccccctcatggtaaaactttgttctttttctttaactcattcaatagatgtttttctttcagattattttgacatatacttttctttcaggtccatgagatcaaccttgttttcaaatttaaaacatgaaatcactgtgttggccatgcagagtgtttggtgtgcagtgagatgcatcagtgaagacagttagcagcctggtacatcttccacctatccaagtcctagacaggagttaaatgcacttattacaatgtactttgtatagcttatgaaaaagataacttatctcctagcaatgagcataccatagttgggatgaaattttgttactt

SEQ ID NO: 304532 - DNA, 453 bp, Homo sapiens
atgtttagaactatctcattaaaaagtaaaagtttatttctttataataaatgagctgatgcttgatatccaggactgtctttgttgggaaatgatatttctcatactgtgtatttgaaaatatctctcttttgtctgtgaacttttctatcaaatatagtattattgtcatataataataattactattttataattaggattctagttgcgtaaagggggtgctaagagaactgcattgatcataatatcatctaataatttgatagccttctgaatcatctgtcttcttgatctagaatcgtgtcaattaaaagtatttgcagagtttttgttgctgtacttctcgttaggtatcagtgtagactatagatatatataaatgtttatacctaatgtggttcaaccaaaacatctgttagtaataaagaagatccttgcctataaaaaatc

SEQ ID NO: 304533 - DNA, 5516 bp, Homo sapiens
  misc_feature (3278)..(3278): n is a, c, g, or t
ccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacagatgttgagcataccggagccaccagngagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaaga

SEQ ID NO: 304534 - DNA, 5901 bp, Homo sapiens
  misc_feature (3278)..(3278): n is a, c, g, or t
ccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacagatgttgagcataccggagccaccagngagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaagaaatcttctttgagtctcttctcttttgtggaaaaaaaaaaaaaaaaaaaaaacaaaaaacatgtgtgttgggccgcgcctggggcccccggaaaacatttttgaaacacacagcatgatgtggggcccgagggcccccaagaggaatagagggtaacaagcaggccaaaagaggtgttaccatagagaaaacacccgggcaaagacaaagagcgacgggaaattcctaccccacaataaaaaaaacgcccgggggggaaaaaccacaggggtctcgtgaaacaactcccaaaaggggacttcagaggggcaaaaaagggggactatctacacacgggagtcccaagaggagcgcccaaatacaaaattatcccccccgcctgtga

SEQ ID NO: 304535 - DNA, 5903 bp, Homo sapiens
  misc_feature (3665)..(3665): n is a, c, g, or t
ccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagcctctatgaaagtagtccggctcccactcccagtttctggagctctgttcccgtgatgggcccgtctcttgcctcaccttcccgtgcagccagccagttggctgtgccttccactcccctcagtcctcacagtgcagcctctggaactgctgcgggaagccagccttcatccccgcggtatcgcccctacactgtcactcacccatgggcgtcctcaggcgtctccattctgtcgagctccccaagtccccctgccctcgccagtagcccccaagcagtgcccgccagcagttccagacagaggcccagcagcacgggtccacccctaccacccgcctcacccagtgccacgagcagacgcccctcctccctgaggatctctcctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacagatgttgagcataccggagccaccagngagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaaga

SEQ ID NO: 304536 - DNA, 5462 bp, Homo sapiens
  misc_feature (3278)..(3278): n is a, c, g, or t
ccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacagatgttgagcataccggagccaccagngagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccgttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaaga

SEQ ID NO: 304537 - DNA, 4533 bp, Homo sapiens
  misc_feature (2295)..(2295): n is a, c, g, or t
tgaccttggaggctgtgtattgcagatggcatagattaaagatggagtaaggatgcttcactctcatcagactttgtcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacagatgttgagcataccggagccaccagngagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaaga

SEQ ID NO: 304538 - DNA, 4635 bp, Homo sapiens
ataacgaggacacagtgagtgagagggtacaataatgagaggcaggaagcggaagactgttgaagctaaaatcagaaatcattgtgatcgttctctaggtcagtggatcctgctgtgccatacgttggaatcaccttggaatcagctggggatctttaaaggtgtttctgcctggctccccaccccagaccttgtgatttaattcaccaggggtgtggcatggcattggggtttccaaaggcttcccatgtgatcctaatatgcagccacgtttgtgaactcctgcactaggcagtgagaacgcttccttctgagttgaggctgcctgaacctcaaaggcatctcaacgttgtgtcaatgcctaaatgcactcttcggctcatgtagcaacttctagagctgcgtccgaatcacagaggaaattaactgttgaaaataatgtttgattgagttaccatgggcatgctaaattatgtttatgtccctaaaaagtgtttttcatcgttctctaatgttaggatggttggatgtctgaaggaaagtgttggaattcttaaaagtactagaaatcttgaaaccaagttatgtttttaaatatgttttgaatttgatagcttattaaattgtaattatttatagtcatgtttaacactggcaagaggagccatctaaagtttatgaaataaatctttttgacatggaaagatatgaagtggaaaaacttttttgtaaaaaacatatatagatacagtacacaaaaatatatctgaaaactgttgctcaaaatatcaatagaggttatctttgagggtaaagcttgagtaatttttagtttcattttatatttctgttttatttcaagttttcacattgcatgtgttttagtttattaatcagaaaaagtagtgaagctgctgccatttcagagggaatgcatgtgtgccattttagagggaacgaatttatagcagcagttaaaactgtttctttatgctacaaatgacagtcagtttaagatgaaatgcatttaaatgactctgatcttatttctaggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctaactgtagaagatttgaaaaataatgaaagccaatggaaagattccccactggcaactagacaccgcgaaatgctgaagcgctgtaaaactcagcttaaggtttgtatagctaagtggaataattatagaccagcctcatagtgataattttcccaacagaatatatgccttgagtgagcagtttagtgtcctcactttttctttgttattcttttcccttccaataaaatagtatattttaaaacttgttgataccttacttatatgtgtatataatgatttcagtctcaggacagaatatggatagatatgcttctgctgtgattatgaattcttaatgggttttatgattctcagtttaacatcacctcccttggccgggcgcagtggctcacacctgtaatcccagcactttgggaggcctaggcgggcggatcacgaggtcaggagatggagaccatcctggctaacacggtgaaaccccgtctctactaaaaatacaaaaaaaaattagccgggcgtgatggcgggcgcctgtagtcccagctactcaggaggctaaggcaggagaatggcatgaacccaggaggcagagcatgcagtgagccaagattgtgccactgcattccaggctgggcgacagagtgagaccctgtctcaaaaagaaacaagattaacataatctaaagagaagcttggtggtccttgaattccatagtgcctgacttgtgccagggtagccaggcttttagggtgagatagttgcagtctgggtggaggtgcttgttccctgggatttgctgtggcattttgcttcagggagatgtatgaccatgtacaatataattgcctttccagctccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaaga

SEQ ID NO: 304539 - DNA, 3828 bp, Homo sapiens
  misc_feature (1590)..(1590): n is a, c, g, or t
caggctcaatgcaatcctcccaccttagcctcccaagtagctgggacctaaagtgatccacccacactggcctcccaaagtgctgggattacaggcgtgagccaccatgcctggctgaaacataaaagttttaataatatcttgtgaaaatacagaggagctggagagttttcattacatttttaccccaccggcctgttcagcggcttgactggctcttccatcttctgcctaggttgcttctttgcggttgtggttgccgaaatccttaagtcctggctgtgggcgggagctgcagagactctcttacttaggggctttctttagcttctcagtctttgcagaagatgatgtaagtatagtggctacttgtactttgctgcccttttattcagattctttcccaaatgtgcattatatgttgactgcattttttccttctctttccaggttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacagatgttgagcataccggagccaccagngagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaaga

SEQ ID NO: 304540 - DNA, 5462 bp, Homo sapiens
  misc_feature (3278)..(3278): n is a, c, g, or t
ccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacagatgttgagcataccggagccaccagngagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtctatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaaga

SEQ ID NO: 304541 - DNA, 2047 bp, Homo sapiens
  misc_feature (1)..(2): n is a, c, g, or t
  misc_feature (7)..(8): n is a, c, g, or t
nncagannagaaatggggagtaaagttgaaatataatgttgtctttcttcagcttatgatacacagcacctgtaaggattctttgaagattaatccaaccaattcctgttcctccactgaaatgggagtttttggtccttttcacttgtctcaacagcatgaattgtcctattatcctgtgatttcctaggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaaga

SEQ ID NO: 304542 - DNA, 5647 bp, Homo sapiens
  misc_feature (3278)..(3278): n is a, c, g, or t
ccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacagatgttgagcataccggagccaccagngagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagaatactcaccattgtgttacaactgccgacaggattcagtacagtcccacactgtacagttttgtagcctaggagcaataggctataccatagagcctcgacgtggtgtaggccacgccatctaggtttgtagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaaga

SEQ ID NO: 304543 - DNA, 5343 bp, Homo sapiens
  misc_feature (3278)..(3278): n is a, c, g, or t
ccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacagatgttgagcataccggagccaccagngagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaaga

SEQ ID NO: 304544 - DNA, 1941 bp, Homo sapiens
ctcagtcctgcagccctctccagagggagtgacctcgtacagtttggcacatattattccagtctttatccatttgtaagcataaaaagtgcatacttttatgaggctataaatgcataaagacggatatataaaatatataagtgtatatataattttagggcttttttagtgggggaaaatccacaaatggataatactttggatattttctgcagctcgcttttttccacctgacgtacatttacgtctcacattgccattcctcctttgcagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaaga

SEQ ID NO: 304545 - DNA, 1774 bp, Homo sapiens
ccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaaga

SEQ ID NO: 304546 - DNA, 1642 bp, Homo sapiens
tgacttaaagccagataacaaccctgaagattctaagggcagggctgcctttgcaagtggggattcacattttcaaagaattcccagaagtcctaagacaaagaattccagcctgccgtcctcgccacggagcctgtggggcctgctgctggaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaaga

SEQ ID NO: 304547 - DNA, 4346 bp, Homo sapiens
  misc_feature (3278)..(3278): n is a, c, g, or t
ccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacagatgttgagcataccggagccaccagngagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaaccaggaccaggcgatactctcgccgcccggcggagtatcgctcaacggagcttctcccaaaatacagctctgcccgggtctcactcctagaccttctttttgtttttgagatgactattgctgagcgct

SEQ ID NO: 304548 - DNA, 4264 bp, Homo sapiens
  misc_feature (3278)..(3278): n is a, c, g, or t
ccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacagatgttgagcataccggagccaccagngagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagaatactcaccattgtgttacaactgccgacaggattcagtacagtcccacactgtacagttttgtagcctaggagcaataggctataccatagagcctcgacgtggtgtaggccacgccatctaggtttgtgtaagtaaattctatgatgtttacacagcaacgaaattgcctaacaagacatttctcagagcgacacatgactgtgtgtctaaagcagttttatcatacaaagtagtggctcgtaagagggttaggaaattttagttacttgtagatgttaaaatatatactgctggccgagcgcggtggctcatgcctgtaatcccagcactttgggaggccgaggcgggtggatcacaaggtcaggagatcacgaccatcctggctaacacggtgaaaccccgtctctac

SEQ ID NO: 304549 - DNA, 2623 bp, Homo sapiens
ccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctgtgagtactgtgttcgtgactcggtcattaaaacactgccctcttgtctgtgtgctagcagttcctcatcctt

SEQ ID NO: 304550 - DNA, 2289 bp, Homo sapiens
ccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggtaaaactttgttctttttctttaactcattcaatagatgtttttctttcagattattttgacatatacttttctttcaggtccatgagatcaaccttgttttcaaatttaaaacatgaaatcactgtgttggccatgcagagtgtttggtgtgcagtgagatgcatcagtgaagacagttagcagcctggtacatcttccacctatccaagtcctagacaggagttaaatgcacttattacaatgtactttgtatagcttatgaaaaagataacttatctcctagcaatgagcataccatagttgggatgaaattttgttactt

SEQ ID NO: 304551 - DNA, 2358 bp, Homo sapiens
ccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagcctctatgaaagtagtccggctcccactcccagtttctggagctctgttcccgtgatgggcccgtctcttgcctcaccttcccgtgcagccagccagttggctgtgccttccactcccctcagtcctcacagtgcagcctctggaactgctgcgggaagccagccttcatccccgcggtatcgcccctacactgtcactcacccatgggcgtcctcaggcgtctccattctgtcgagctccccaagtccccctgccctcgccagtagcccccaagcagtgcccgccagcagttccagacagaggcccagcagcacgggtccacccctaccacccgcctcacccagtgccacgagcagacgcccctcctccctgaggatctctcctaggtatttatcccacaggagagttgcatgtgtgtttgcggtgcagggaaaggagattaacacggtttggaagaagtgctgtgtgacactgactctgttaaattgttgttttgggttattaacctgtgtggctaactagtttggtaggcacgtactctgagtccatgcttctgccaggctctaatcatgctggaaagtttgggttgctctattctattgtgaatccctttcttccctttgagagttggggcacacaggaaccctttttggccttttgtcctgttgccagtggtagttgaaatgctatcagaccaagcaggtgtgggagcaaatctgggcctggtgttttttacttctggtgagtggggtgggtcggttcatgtcctgacgtgttgagttttagttatatgtaagttcagtctcttagaaggaagcagtatcagaattccact

SEQ ID NO: 304552 - DNA, 1190 bp, Homo sapiens
ccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggtttaggtattatctctgatgacaagatgattaagactgaatttggttctgctgattttaatatcatctaataatttgatagccttctgaatcatctgtcttcttgatctagaatcgtgtcaattaaaagtatttgcagagtttttgttgctgtacttctcgttaggtatcagtgtagactatagatatatataaatgtttatacctaatgtggttcaaccaaaacatctgttagtaataaagaagatccttgcctataaaaaatc

SEQ ID NO: 304553 - DNA, 1062 bp, Homo sapiens
ccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggtttaggtattatctctgatgacaagatgattaagactgaatttggttctgctgattttatgaatttggttgatggttttaagataaaataatctgaaaatgcaagattaaaataatggtcaaaatgaacacctctaa

SEQ ID NO: 304554 - DNA, 590 bp, Homo sapiens
atgacagaccccgtgcggctgccctctggcaccatcatggaccgctccatcatcctgcggcacctgctcaactcccccacggaccccttcaaccggcagacgctgacagagagcatgctggaaccaggtagaggagggtgcagtttgaggtgcagcgctggcgtcagtaccaagagataaagcccaagtcacatattggagatgaagcagaagggaaatttatcaaatgcagaaactacctactttatgacactctgtagcaaagacccaaaacactcttggccctttttccctgcagacatccagtccctccctctcatgtcccagtccttctggagtcttcggctcaatgagggaaagaatggccttttcttcccatttatacagagcgacaagcatcctctctcaggaagagccctcccatctggggcattaatcctcctttttttcttttctcagtgccagaactgaaagagcagattcaggcgtggatgagagagaaacagaacagcgatcactaaaccgttccgccgcccaccctctgctagacacagccaaggccaacgaggcaagcagaagcagcggccgca

SEQ ID NO: 304555 - DNA, 241 bp, Homo sapiens
ctgtagctcgttcactaagaataaaggaagaggaaagcacgctgtttactgatggtccatcccttttaactcttatttttaacagcatggaattgtattgtttgtttcttgtcgtcctcacttccacctttccttttcagatgtgcagccagccagcagtcagccagcttctgagcaacatccgctcacagtgcatatcccatactgctttagtactacaaggctccctaacacagcccag

SEQ ID NO: 304556 - DNA, 574 bp, Homo sapiens
cccagtattttaggaggccgaggcaggaatatagcttgaacccaggagttcaagaccagcctgagcaacatgagacctgtacaaaacatttaaaaaattgctgggtatgatggtgcacacctgtggtcccagctactcaggaggctgaggcagaaggatcacttgagcctaggaggtggaggctacaatgagccatatttgagtcactacactccagcctggatgacaaagtgagaccatgtgtcaaacaaaatacagaaagaatattaatttaaaattttgaaagaggagtgatctgaacttatatcttaaaaagatcattctagggcatggtggctcatgcctgtaatcaagggctttgggaggctgagacaggaggatcacctgaggccagttcgagatcaacctgtacagcatagagagactccatctctacaaaaagaaaaaataaatagctgggtgttgtgagttattcaggaggctgaagcagaaagatcacttgagcccaggagtttgaggctgcagtaagctatgatcccaccactgcaacacagtgagatcttgtctcaaaaaa

SEQ ID NO: 304557 - DNA, 291 bp, Homo sapiens
  misc_feature (14)..(15): n is a, c, g, or t
actctagcaggatnntattactggcattttcagtctgattgaaatgcagaaatcctgtcctgggctgattctggtctccagtctacacaggccggtgttttccatagctttgaacttgtggaattgatttaacatgctccttccagaaagcaagctgtgtttttggagtggggggcggtagtcggggaggaggtggaagagaagcaagaaaaggaggaagagtgattggttaaaaaaaatacagttacccattagttaccattgaataggtgcttactataatgccaggta

SEQ ID NO: 304558 - DNA, 1884 bp, Homo sapiens
aaatagattcatgtcttcttgtagctaccccaagctctctttaccaactttgccgactctgtatccgaagctacataggaaaaccaagattgcaccttatcccacaactccagctgccaacgttactgaagaatttcttacagtatcgataaaacagtaaagtaattctaaataccttgaaaatcaaaatttctatttcttttgcttaaggaatagttcatataaaaatatgctaaagataggataaaagtgagtgtgagatcacccagggaagcagtaaaatatcaattttcattttaagtgtattagtactattgttttatcatttatgctgtctttggattatagcatatttataatatctattttttgttatttcaatataccctcttgtttattcaggaaaaaataataaagtcactatcttatgttttcttttggattggaaagaaataaagctcctagtaaagttattcatattatatttaaaaaggtctatgttcttcaactaatgggttaactttttaattttggctattgtaattggctaacttgttactgatattgacataaaatatgaatatggcttagcaaagagcaactaatatgttttctgaaaccaggatgatgctcattcaggaaatccactatgttgaatgtccactggtcattagaatgaacacttcataaagataaattgcccccctcccccccacttacccctggcaaaggactcacaagtcacttctcttctccatagtacatggacttgttacagaaaagtgataggatgaaaggtcaatactgccctctcaccctgagatatttagaacattacacaccttctaaggctatgttaagactgcctccttctcaggagtagcccctgatgatctcttatcaaggcggttatatgcatattactccagccttcttccatttcagaaattgtcaatagctagtgatacttggacttaagaaaatgaactatatatctaattaacaaacaggccctggatcatattccggggatcatcacatcagtccaaggatataaaaaaatggaagattaaaaactcaaattgtggagtttttaaagagtgggtgccacttaacacattggagaccttaaaaaatgtatatagagaacttaatcgcactgtttctaattctttttacacaaaacaagggcttagagtatactgtatttgcaagtaatagcaagagagtatgtataaaagaagatattactaagctagtcctctgcaagggtaaatactatgtttattctcttcagctttaactatacttgagtgcaataaaaaacttaataaaattttatgcctgtttgtaattcagggcctattatgattttagaaataagataatcaacgtacaactctttgtaaaacaaaagcaacttgggtgagttttatagatttattaaatttgataaagtaaatatttgaccactattttcaacaacccaggcttattttcttctgacttcttggctaacttccagactatgggaaaataaattatgattgtatgtgacccccagatcactaagcttgcatttggcagaaagaaaaaaaatcagttgtgatttaaaacgttgttgagattttcaaacatagaaataaagctgtagcatattcactaaacaatgttttatatgaggatagggacctttaaatatgtgttttatagaatatctcacacatttgtaatggataacgtgcattaaaatggagttcttattatagaataacctggttaaacagatattaaggggttgggtaacaggttccacagtatttccgggcagagggagcttgatttggagataaaccttcttttgtctggggaaaaattaaaggc

SEQ ID NO: 304559 - DNA, 2078 bp, Homo sapiens
aaatagattcatgtcttcttgtagctaccccaagctctctttaccaactttgccgactctgtatccgaagctacataggaaaaccaagattgcaccttatcccacaactccagctgccaacgttactgaagaatttcttacagtatcgataaaacagtaaagtaattctaaataccttgaaaatcaaaatttctatttcttttgcttaaggaatagttcatataaaaatatgctaaagataggataaaagtgagtgtgagatcacccagggaagcagtaaaatatcaattttcattttaagtgtattagtactattgttttatcatttatgctgtctttggattatagcatatttataatatctattttttgttatttcaatataccctcttgtttattcaggaaaaaataataaagtcactatcttatgttttcttttggattggaaagaaataaagctcctagtaaagttattcatattatatttaaaaaggtctatgttcttcaactaatgggttaactttttaattttggctattgtaattggctaacttgttactgatattgacataaaatatgaatatggcttagcaaagagcaactaatatgttttctgaaaccaggatgatgctcattcaggaaatccactatgttgaatgtccactggtcattagaatgaacacttcataaagataaattgcccccctcccccccacttacccctggcaaaggactcacaagtcacttctcttctccatagtacatggacttgttacagaaaagtgataggatgaaaggtcaatactgccctctcaccctgagatatttagaacattacacaccttctaaggctatgttaagactgcctccttctcaggagtagcccctgatgatctcttatcaaggcggttatatgcatattactccagccttcttccatttcagaaattgtcaatagctagtgatacttggacttaagaaaatgaactatatatctaattaacaaacaggccctggatcatattccggggatcatcacatcagtccaaggatataaaaaaatggaagattaaaaactcaaattgtggagtttttaaagagtgggtgccacttaacacattggagaccttaaaaaatgtatatagagaacttaatcgcactgtttctaattctttttacacaaaacaagggcttagagtatactgtatttgcaagtaatagcaagagagtatgtataaaagaagatattactaagctagtcctctgcaagggtaaatactatgtttattctcttcagctttaactatacttgagtgcaataaaaaacttaataaaattttatgcctgtttgtaattcagggcctattatgattttagaaataagataatcaacgtacaactctttgtaaaacaaaagcaacttgggtgagttttatagatttattaaatttgataaagtaaatatttgaccactattttcaacaacccaggcttattttcttctgacttcttggctaacttccagactatgggaaaataaattatgattgtatgtgacccccagatcactaagcttgcatttggcagaaagaaaaaaaatcagttgtgatttaaaacgttgttgagattttcaaacatagaaataaagctgtagcatattcactaaacaatgttttatatgaggatagggacctttaaatatgtgttttatagaatatctcacacatttgtaatggataacgtgcattaaaatggagttcttattatagaataacctggttaaacagatattaaagctgcttttgggtaaaacaggtttccaccagtattttccctgagctagaggagaagtcttagattttaagagtaatacaacccatctatcttattagtcttgtgccaataagagaagtaaatatcaaacattaaaatggtcactttacaatttcagtatgtctgtaccttgtatcttagcttgagtatgattgtcttatcaaagtagtgttctaactttaatgtattgtatgtttgttattatattaaagtgtgattattattcattggaataaaaaactttg

SEQ ID NO: 304560 - DNA, 2446 bp, Homo sapiens
tcccagtcgcgcgcacgggccgggcgtctcgactcccgcgcgcgctcggctggtcccagtccccgggagaagaagcggaggagggagagagccagcgaggcggcccaggggagcgggcgcgagtggcggctgccggagccgcctgtgcacgggcggcggcgaggcgagggtggcggtcgcctgagcagctagagccggggcggcgcggaatccgcatccgccgcgagtgtgatgaagctaccctgcctcgctgctccgcttgccgccagctgacaccgcctgcacccagcccgcccgggaggggagacgccgcggggccgtgaccttggcggaggagggcacactgataattcttgtatcttgagtgtggaccaagttttgggtgacatggcccaggggaataattatgggcagaccagcaacggggtggccgatgaatcacccaacatgctggtgtacagaaagatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagtggaggcgctccatttgggaacattaatggctgcccacggctacttctttccaatctcagatcatgtcctcacactcaaggatgatggcaccttttaccggtttcaaaccccctatttttggccatcaaattgttgggagccggaaaacacagattatgccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattaaaagatgcagaatctca

SEQ ID NO: 304561 - DNA, 872 bp, Homo sapiens
agggaggggggaaggcaggttggtcatgaggtttgaactaagatggacttaaagggttcagtgttgaccttgcacaaaaatcagctacagtaaatagttgctactactaagcaggttttcagtgatcgtacttgattttctttcttttctcttgttttatatattttctcaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattaaaagatgcagaatctca

SEQ ID NO: 304562 - DNA, 2581 bp, Homo sapiens
tcccagtcgcgcgcacgggccgggcgtctcgactcccgcgcgcgctcggctggtcccagtccccgggagaagaagcggaggagggagagagccagcgaggcggcccaggggagcgggcgcgagtggcggctgccggagccgcctgtgcacgggcggcggcgaggcgagggtggcggtcgcctgagcagctagagccggggcggcgcggaatccgcatccgccgcgagtgtgatgaagctaccctgcctcgctgctccgcttgccgccagctgacaccgcctgcacccagcccgcccgggaggggagacgccgcggggccgtgaccttggcggaggagggcacactgataattcttgtatcttgagtgtggaccaagttttgggtgacatggcccaggggaataattatgggcagaccagcaacggggtggccgatgaatcacccaacatgctggtgtacagaaagatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagtggaggcgctccatttgggaacattaatggctgcccacggctacttctttccaatctcagatcatgtcctcacactcaaggatgatggcaccttttaccggtttcaaaccccctatttttggccatcaaattgttgggagccggaaaacacagattatgccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagtctggaaactcaatggatcgcagaacatcttttgaaaaatttgcacagaatgtgggcagaaacatccctattttcccatgccataaaaactgtacaccaacactgagggccagcactaacctgttatgaaaagaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattaaaagatgcagaatctca

SEQ ID NO: 304563 - DNA, 2044 bp, Homo sapiens
attatgttagatggccgggcgcggtggctcacgcctgtaatctcagcactttgggaggccgagatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagtggaggcgctccatttgggaacattaatggctgcccacggctacttctttccaatctcagatcatgtcctcacactcaaggatgatggcaccttttaccggtttcaaaccccctatttttggccatcaaattgttgggagccggaaaacacagattatgccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattaaaagatgcagaatctca

SEQ ID NO: 304564 - DNA, 4487 bp, Homo sapiens
atcccagccaagccggagaggaggcgagcggcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgtcggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaataca

SEQ ID NO: 304565 - DNA, 4558 bp, Homo sapiens
atcccagccaagccggagaggaggcgagcggcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaacctttgctagggcaagcctgtctaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgtcggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaatacacatggacgaagtaaacctctggtcttttcgtgggggaaagaagagtct

SEQ ID NO: 304566 - DNA, 3216 bp, Homo sapiens
tgtgatcagaagtggggcagggctttaacaacacccctctgcctggctccccacctgggcctccccaccacgtccagccattccatgtatcacctgtgttctgcctgtcaagctctgttcccagaatctggatgcaggagctgggagtgtggctctgttttgagctgagtcgagaggaggggccctgtgtgtccttggaggccccgggctcatcctctgcctggctgtggtttgtgggatttctatggggtcgtgagcatgaggctcctgtagttactggtgcccagcgccgcgcagctcacggtcctccaggagccacacggcccccaccaggcgggctccaggcctggtgcccagccccttctctgagactctggggttatcttgcgtcatgttctgaggcccacctgggctctctcccgcctgtgaggttggcagcacctttcttggatcatgttctttgtctgggatggagggagggaagaattctccgttgcatggctcgcgtcttctgctttagaattcagccagctacaaatcctaactccctccccacctctcttttctcctgaaaacagaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgtcggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaataca

SEQ ID NO: 304567 - DNA, 714 bp, Homo sapiens
cacgcccagcctagagtcttcacccctgtgatcttggtttcccagtaagatggggacgaacaactgtccggacctggtgctctggggtgccttcctgggggctgtgccggctgcttgggatcgagagatcacctggcatttgtgatgcaaccttcatttttaaaatttcaaatgcacactagaaaatcctactaaagattttctttttttttttccttttccaacctgtttcttcctctcccccactctgcttgaaagacgaactgtctgtcacattttctcaaagttttctccttactaactgtggaaggtaaatgcctgggtgcatgtccctctgtcccgcaccgcgtcacggcatctgggtctgtgtgcagactggccatcgtgcaatgcggggctcatctgtctccatgccgaggttgttaagtgcaacaccattgtcgtgaggtcctttctagtctgtctctcaccccccacgtgtcctgagctggggcccctgggtgaaggacgtggacatcacccggtcttgcaggctctccactgttattgttgcatcgccatcacctgtgggtgccggaagctgtgggctggtggtgttgaggacaggttggagccagcagatgcggagggaaatgtcagccctgctctgtgatcccacagcccggctggggctctccctagatatgaggacccagggctctctgaagagaattg

SEQ ID NO: 304568 - DNA, 5143 bp, Homo sapiens
atcccagccaagccggagaggaggcgagcggcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgtcggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaatacaaaaaaaaaaaaaaaaaaaaaaaaaaaaaaaaaaaaaaaaaaaaaaaaaaaaaaaagaaaaaaaaaaaaaaaaaaaaaaaaacaaacaagacgaaacaaaaaaaaaaggggggggcggacgaaagctcacgacgggggaccacaagacagacacaagaaataagaaagagaaggcggcccaacaaagcgggagagcaacacaaacaaagagacgaggaggcgcataaaaaacacacgccagagaggaaaccgacgacggagtcagcgtgagagaccacacacaggcgggcgaacaaaagagaagaaaaccaccgaagaaaaacgacaccgcgagaagcacaagacaaaagggaaggctggcggcaaccaaagcgaataagggcgagaagaaacacaccaacgacggagcacggaaaaatcgggggcgagctaaacaagaagaagaaagaggcagcacaaggagaagagagagacaagcgacaggcaagaaccggcgagagagaggaaaagacggacagaagaaagaaaacggaaaaccacgaggagaaaacacaaagcgaagaaaggagcgagaacaaggacaaaaaaaacaacgaaacagcacaaacggacagacaacagcaccgacggacagaaaacacattaaacccgcgcctt

SEQ ID NO: 304569 - DNA, 4059 bp, Homo sapiens
atcccagccaagccggagaggaggcgagcggcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaataca

SEQ ID NO: 304570 - DNA, 4582 bp, Homo sapiens
atcccagccaagccggagaggaggcgagcggcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaacctttgctagggcaagcctgtctaaactggaaaggtgtgatgaggaatgcagcctgagatgctgaaaagaatgactggctttggaaatgggagagaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgtcggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaataca

SEQ ID NO: 304571 - DNA, 4562 bp, Homo sapiens
atcccagccaagccggagaggaggcgagcggcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaacctttgctagggcaagcctgtctacgaactgtctgtcacattttctcaaagttttctccttactaactgtggaagaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgtcggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaataca

SEQ ID NO: 304572 - DNA, 4605 bp, Homo sapiens
  misc_feature (1707)..(1707): n is a, c, g, or t
  misc_feature (1779)..(1779): n is a, c, g, or t
atcccagccaagccggagaggaggcgagcggcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagagggtctcagtctgttccccaggctggagtgcgntggcgcagtcacggctcactgcagcctcaacctcctgggttcaagtgatcctcccgcctcagcctcccgcgnagctgagactacaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgtcggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaataca

SEQ ID NO: 304573 - DNA, 4313 bp, Homo sapiens
atcccagccaagccggagaggaggcgagcggcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagagaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgtcggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaataca

SEQ ID NO: 304574 - DNA, 4208 bp, Homo sapiens
atcccagccaagccggagaggaggcgagcggcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagagaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgtcggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaataca

SEQ ID NO: 304575 - DNA, 4177 bp, Homo sapiens
gcgccccgagtcgcggggctgccgcttggacgtcgtcctgtctgggtgtcgcgggccggccccgcggggagcgcccccggcgcgatgcccttcaggaaagcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgtcggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaataca

SEQ ID NO: 304576 - DNA, 4587 bp, Homo sapiens
atcccagccaagccggagaggaggcgagcggcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgtcggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaatacaataccaaaacacagacacgcgacacacacacacacacacccacacagcaaccacgcaccaacacacgcaaaacacaacgggggggggcgcacacacaaaa

SEQ ID NO: 304577 - DNA, 4439 bp, Homo sapiens
atcccagccaagccggagaggaggcgagcggcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgtcggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaaaggcatctcctgtttgaaagctagcatagctttatatcccaggtcattaattcgtcgacc

SEQ ID NO: 304578 - DNA, 3172 bp, Homo sapiens
atcccagccaagccggagaggaggcgagcggcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgtcggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcaatggctcccgggggagtggacgggggctctgcccgttaacctttggaatcgcagaagtggccccttcgagattcaccgtgcaggct

SEQ ID NO: 304579 - DNA, 1592 bp, Homo sapiens
atcccagccaagccggagaggaggcgagcggcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggaggtgagcgcaggctggggcgggctgacggtccccagcacacatgaccactgctgtgcagggctgggccacccctccagggagttcacttccgtgtgggttctgggggctcctacaccctccacctcggaactgagtccccccaaactgaaccttctaacagcctggggtgaagtgc

SEQ ID NO: 304580 - DNA, 514 bp, Homo sapiens
gggtgggtggggagctgtgtgctgctgctgctgctgctgctgctgcttggtgtgcttgctgtgtgtgttatctgtgtgtgcgcctgcacgtctctatgcatatctgtgtgcatctctgtatggctctgtgtgtgtgtgtgtctacgcctatccatgtggctttgtgtgtgtgtgtctttgtgttactttgtatgtgtttgtatgtgtgtctctggtgtgtgtatctctgtgcatgtgtgtgatgtgtgcgcggttgtgcactaggaagggaaggggcaggaagagctgagcctggtctctgggtagggtgtgtgcggctgtggctgtcccagtggcctggggcccccacggtgtaaccaggtagtgcacagccctacgtgggctgcctgctccagccctggctcttggaggagctgcgggcatctggaatcagtggtccccctccaccacctctcagtttgccagtgctctgagcaagttcgtggaggagcagaacctgaaggacctgcgcgtg

SEQ ID NO: 304581 - DNA, 401 bp, Homo sapiens
gttttcgatgccaccaatactactagagagaggagacacatgatccttcattttgccaaagaaaatgactttaaggtgagctgagcgtcttgtgttgtgctagagggctcgggagagaggaaaaggcttcaggaagcggcctgagtcctgcttggtccttcccctcctgctgcccatgttccttagtcctgctcggtccctcccctcctgctgcccacgttttgtggccttaaatttgggcctttgtgtggtagggctcttgggggccatggggcgttccagaggctgcagtgaggaggtgggctttcctgtgtttgggagttggtgggtggcgtgcttccgccttgtccgggtgatgacatcgcagtgatggcaaggttgatccttcgtggtgtttgttt

SEQ ID NO: 304582 - DNA, 209 bp, Homo sapiens
ctggtccagcgcttggagccagtgatcatggagctggagcggcaggagaatgtgctggtcatctgccaccaggccgtcctgcgctgcctgcttgcctacttcctggataagagtgcaggtacctcgggcaggtcgtggccccgggatggagggaggaggggactggcactcggcggggggtcagccgcagacctgccgtggcctgccct

SEQ ID NO: 304583 - DNA, 5439 bp, Homo sapiens
gcttgcgcgttagagatcgctgtccgctcttcctattggttcgtttttaggagctcggggaatacgaaatatccagccaataggagcagagatgccggaaccgggcttgtgtgcctctgctgaggtgatctggcgcagagcggaggaggtgcttggcgcttctcaggctcctcctctccccttgcggcctttctaacgttggccctgctcttgtggcctcccgcagaatgtggatgacgcccaaaagaagcaagatggaagtcgacgaggctctagttttccggcccgagtggacccagcgttatttggtggtggagcctccggagggcgatggggccctgtgcctggtctgtcgccgcctcatcgtagctacccgcgaacgcgacgtcaggcgccactacgaggctgagcacgaatactacgagcggtatgtggcggacggcgagcgcgcggccctggtggagcgtctgcgtcagggcgacttgcccgtggcctccttcactcctgaagagagagctgctcgtgcaggcctcgggctctgccgcctcttggccttgaagggtcgcggctggggtgagggggactttgtataccagtgcatggaggtgttgctgagagaggtactgcccgagcatgtaagcgtcctgcaaggcgttgacttatctccagatatcacaaggcagaggatcctgagcattgacaggaatctacgcaaccagctttttaaccgagccagggactttaaagcctattctcttgccttggacgaccaggcttttgtggcctatgagaactacctcctggtctttatccgcggtgtaggccctgagttggaggtgcaagaagatcttctgaccataatcaacctgactcatcatttcagtgttggtgcgctcatgtcggcaatcctagagtccctgcagacagcagggcttagcttgcagagaatggttggactgaccacgacccatactttgaggatgattggtgagaactcaggactcgtctcatacatgagagaaaaggccgtaagccccaactgttggaatgtcattcattattcaggatttcttcacttggaactgttgagctcctatgatgtagatgttaatcagatcataaataccatatccgaatggatagttttgattaagaccagaggcgttaggcgacctgaatttcagactttactaacggaatctgaatcagagcatggtgaaagggttaatggacgatgtctgaacaattggcttaggagagggaaaactttaaaactaatattctctctaagaaaagaaatggaagcgttcttggtttcagtaggggcaacaacagtccacttctcagacaaacaatggctttgtgactttggcttcttggtggacattatggaacaccttcgagaactcagtgaagaattacgagttagtaaagtctttgctgctgctgcctttgaccatatttgtactttcgaagttaagctgaatttatttcaaagacatattgaggaaaaaaatctaacagactttcctgccctcagagaagttgttgatgagctaaaacagcaaaataaggaagatgaaaaaatatttgatcctgataggtatcaaatggtgatctgtcgtctccaaaaagaatttgagagacattttaaggacctcaggttcattaaaaaggacttagaacttttttcaaatccatttaactttaaacctgaatatgcacctatttcagtgagggtggagctaacaaaacttcaggcaaacactaatctttggaatgaatacagaatcaaagacttggggcagttttatgctggattgtctgctgaatcctacccaattatcaaaggggttgcctgtaaggtggcatccttgtttgatagtaaccaaatctgtgaaaaggctttttcatatttgactcgaaaccaacacactttgagtcagccattaacagatgagcatctccaagccctgtttcgggttgccacaactgaaatggagcccggttgggatgaccttgtgagagaaagaaatgaatctaatccataaggctttgtagtacaagattgaaaaactcaacaagaatttaattctaaaagcaaaaattggtttgagttttcaagtttactaatttggattgtgagaaagtaccaagtaccagccgtccaaactgatcacaattaaaattctgacagttgccttttttttcatctcaaatggcagcatgggactgaaacatgagaatgccaccttttttaaaacttagtttagtgacaaagtcattgtcttttatgatatagttaattttaaagagatttagtattaatgtgagttgaatttgcagtctgttttttaggtgttctgaagataaatgccaaaaatttcagctcttattttaatggagtgttaaaattctgattcatatagtcttaaattatcaactccttaaatgtgcttttgaaccaatttgcagaagctcacatagcaagttcataagtttccaaaaaggaagcccatacataacagtggaggtgttttgtctaaccatcaaaatgtttgagacttttttttaaacatttctgagttcgaaggtaatactgacagatttcttccctcttccctccccatcacccacctcagtgataacacattactgatagaggaagtcattagaatcatttttaagtttcagatataggagacttcatgcaatttggagataagactaattattgggggttttccttggattttttttttaataactgggggctattttatcagcttgcctattaaaggactatggtaagtatagaatcttaatggttgccagttagtaattctttttttttttttttttactgtagacacaagtttggccctatcaaaaacgatgaggaaaaaagattgcactccaggattaggaggtgtgagatattttagcttttttgtcttatctgcgtgggtattgctgctttattttaaaaaatcctgcctaaagtaaacactttgttttaaaatgatacagtatcagattttgttagatgctagaaatggatttattctaaaatttggaactgtcgtacacattctatatgtaagatagcacacaagtagaaatatttaaaagcagtcttattcacagattgcagtaattctgtatttctactaagataatctgctttgtgccaaaacagtaatttccaaacttctgttcaccatgaaaaggcaatcttaaagttcattatgtaaaactaattataaacaggacccaatttatattcatagatcctctcaagtattatacaatttaaaaactcttgttccaaagtcctgtcttaactattgaaacaccttaatctgtggttactaatccagcaaattcaaggaaccaggctatgactaagaatttaggtggaattgatgtctgggcaattaaaataaatggcataagagcttaaaaaccaaagttgtgccagtggctttcaactagaggcagtaacctgtcattccagaggatgctgagaaatgtgtaggggcacttttttggttgtcatatttactaggggcttctgttggcatttaagcctaaagacactcacccctgcagtgcatgggacagcctggcacaatgaagaattagccctcccaaaatgtagattattttatttcaagggatagggcagattaccattagaagcaaaattaaaagtacaagctgggcaaactgacagaatactagataggagagactaattccaaccttctaaatttggctagtaaagtgcaataaaggcattgataagttctgttagctcaccatagcacttgtaaatcaggaattaataattgaatcagatttaagggctctgtcctgttatacatatttaaggcagaaaaaaagttacatgtcgattaggtacttatcaagaatggtcaagctgagattttggttaatagagtaagcttacatatctagagaaacaacatagtggaaaaccgaaaaaaaaaaacagaaaaatctaccggtaatttcccaatagctttgaatattcacagcagagctttattacttgagagaaagactggaagacctgaaagccacttctgctttctaaccccagttccttaaatattgaaatcttgtacattttgtgaaattccagtatgttttgcttaaggtgttaataaaattagtttgcatcatgtagtcattgagtgagggggagatataagccaaggattttaaattgacccttagctatagagaatttgctataagctagtcttgtttgtaaaaaaaaaaaaaaaaaaagaaaaagaaaaaagtgtattttactgttttctgtattaagtaattctgtaactgcatggcagtctttttttttttaaataaatatagttgttactggtcctgttgtagcagtgaatatagttaaaatacgtacattaaaaaaaaaattattaggtccttaccagttactgtcctatagctcattcctactagttttcttgacagatttgtattcccagtgtcccgtattgccactcaaattgctctactatgctaagtccttgttaatagtcttaccctccttgaaacacttgaacacttgatgactttagctttgaggagataccatctccaggtgtgctttcttagtctttgcaggcacctcttcccttcaatatctgttcttcgtatttttaaaaaaatttgttttagactgccttgttctgtgtcagctcgctagctgatctcatttccttccatggtttccttaccatttatatgcaaatgactgtcagattcatatctcctttctagatcttccctaattgatgtatctaattgctaacaaatgctctttgctgtctcaggcactacatgtcattgatcttgcccccaatcctgctcctcctctcatgtttcctctttgactaaatggcattaccactaccaaccattcatttgtcctttttaccaattctccaatgctgccattttaattcaggccatcaacctacctaaattatagcaacagcctccttattagtctccctgttttttatttttattcctttctacactacaaccaaattgctccaaaagacttactgatcatgtcactgcattgctttcaccattgctcttagggtacaatacaaatttatcttcatctttaaggtctcagtatgccacttcatctaggaaaccttcattgatgccctctagattaggtgcccttactatccattccctatacaccctgttctttcccagacatacacttggcacactttattgttactgcttattgatcactgctagactgtaagctttgtaagggcagggaccatataagccttgttcactgttatatctctagtgcttagcacaatgcctggcatttcaataaatgtttggacaaacgaa

SEQ ID NO: 304584 - DNA, 5569 bp, Homo sapiens
gcttgcgcgttagagatcgctgtccgctcttcctattggttcgtttttaggagctcggggaatacgaaatatccagccaataggagcagagatgccggaaccgggcttgtgtgcctctgctgaggtgatctggcgcagagcggaggaggtgcttggcgcttctcaggctcctcctctccccttgcggcctttctaacgttggccctgctcttgtggcctcccgcagaatgtggatgacgcccaaaagaagcaagatggaagtcgacgaggctctagttttccggcccgagtggacccagcgttatttggtggtggagcctccggagggcgatggggccctgtgcctggtctgtcgccgcctcatcgtagctacccgcgaacgcgacgtcaggcgccactacgaggctgagcacgaatactacgagcggtatgtggcggacggcgagcgcgcggccctggtggagcgtctgcgtcagggcgacttgcccgtggcctccttcactcctgaagagagagctgctcgtgcaggcctcgggctctgccgcctcttggccttgaagggtcgcggctggggtgagggggactttgtataccagtgcatggaggtgttgctgagagaggtactgcccgagcatgtaagcgtcctgcaaggcgttgacttatctccagatatcacaaggcagaggatcctgagcattgacaggaatctacgcaaccagctttttaaccgagccagggactttaaagcctattctcttgccttggacgaccaggcttttgtggcctatgagaactacctcctggtctttatccgcggtgtaggccctgagttggaggtgcaagaagatcttctgaccataatcaacctgactcatcatttcagtgttggtgcgctcatgtcggcaatcctagagtccctgcagacagcagggcttagcttgcagagaatggttggactgaccacgacccatactttgaggatgattggtgagaactcaggactcgtctcatacatgagagaaaaggccgtaagccccaactgttggaatgtcattcattattcaggatttcttcacttggaactgttgagctcctatgatgtagatgttaatcagatcataaataccatatccgaatggatagttttgattaagaccagaggcgttaggcgacctgaatttcagactttactaacggaatctgaatcagagcatggtgaaagggttaatggacgatgtctgaacaattggcttaggagagggaaaactttaaaactaatattctctctaagaaaagaaatggaagcgttcttggtttcagtaggggcaacaacagtccacttctcagacaaacaatggctttgtgactttggcttcttggtggacattatggaacaccttcgagaactcagtgaagaattacgagttagtaaagtctttgctgctgctgcctttgaccatatttgtactttcgaagttaagctgaatttatttcaaagacatattgaggaaaaaaatctaacagactttcctgccctcagagaagttgttgatgagctaaaacagcaaaataaggaagatgaaaaaatatttgatcctgataggtatcaaatggtgatctgtcgtctccaaaaagaatttgagagacattttaaggacctcaggttcattaaaaaggacttagaacttttttcaaatccatttaactttaaacctgaatatgcacctatttcagtgagggtggagctaacaaaacttcaggcaaacactaatctttggaatgaatacagaatcaaagacttggggcagttttatgctggattgtctgctgaatcctacccaattatcaaaggggttgcctgtaaggtggcatccttgtttgatagtaaccaaatctgtgaaaaggctttttcatatttgactcgaaaccaacacactttgagtcagccattaacagatgagcatctccaagccctgtttcgggttgccacaactgaaatggagcccggttgggatgaccttgtgagagaaagaaatgaatctaatccataaggctttgtagtacaagattgaaaaactcaacaagaatttaattctaaaagcaaaaattggtttgagttttcaagtttactaatttggattgtgagaaagtaccaagtaccagccgtccaaactgatcacaattaaaattctgacagttgccttttttttcatctcaaatggcagcatgggactgaaacatgagaatgccaccttttttaaaacttagtttagtgacaaagtcattgtcttttatgatatagttaattttaaagagatttagtattaatgtgagttgaatttgcagtctgttttttaggtgttctgaagataaatgccaaaaatttcagctcttattttaatggagtgttaaaattctgattcatatagtcttaaattatcaactccttaaatgtgcttttgaaccaatttgcagaagctcacatagcaagttcataagtttccaaaaaggaagcccatacataacagtggaggtgttttgtctaaccatcaaaatgtttgagacttttttttaaacatttctgagttcgaaggtaatactgacagatttcttccctcttccctccccatcacccacctcagtgataacacattactgatagaggaagtcattagaatcatttttaagtttcagatataggagacttcatgcaatttggagataagactaattattgggggttttccttggattttttttttaataactgggggctattttatcagcttgcctattaaaggactatggtaagtatagaatcttaatggttgccagttagtaattctttttttttttttttttactgtagacacaagtttggccctatcaaaaacgatgaggaaaaaagattgcactccaggattaggaggtgtgagatattttagcttttttgtcttatctgcgtgggtattgctgctttattttaaaaaatcctgcctaaagtaaacactttgttttaaaatgatacagtatcagattttgttagatgctagaaatggatttattctaaaatttggaactgtcgtacacattctatatgtaagatagcacacaagtagaaatatttaaaagcagtcttattcacagattgcagtaattctgtatttctactaagataatctgctttgtgccaaaacagtaatttccaaacttctgttcaccatgaaaaggcaatcttaaagttcattatgtaaaactaattataaacaggacccaatttatattcatagatcctctcaagtattatacaatttaaaaactcttgttccaaagtcctgtcttaactattgaaacaccttaatctgtggttactaatccagcaaattcaaggaaccaggctatgactaagaatttaggtggaattgatgtctgggcaattaaaataaatggcataagagcttaaaaaccaaagttgtgccagtggctttcaactagaggcagtaacctgtcattccagaggatgctgagaaatgtgtaggggcacttttttggttgtcatatttactaggggcttctgttggcatttaagcctaaagacactcacccctgcagtgcatgggacagcctggcacaatgaagaattagccctcccaaaatgtagattattttatttcaagggatagggcagattaccattagaagcaaaattaaaagtacaagctgggcaaactgacagaatactagataggagagactaattccaaccttctaaatttggctagtaaagtgcaataaaggcattgataagttctgttagctcaccatagcacttgtaaatcaggaattaataattgaatcagatttaagggctctgtcctgttatacatatttaaggcagaaaaaaagttacatgtcgattaggtacttatcaagaatggtcaagctgagattttggttaatagagtaagcttacatatctagagaaacaacatagtggaaaaccgaaaaaaaaaaacagaaaaatctaccggtaatttcccaatagctttgaatattcacagcagagctttattacttgagagaaagactggaagacctgaaagccacttctgctttctaaccccagttccttaaatattgaaatcttgtacattttgtgaaattccagtatgttttgcttaaggtgttaataaaattagtttgcatcatgtagtcattgagtgagggggagatataagccaaggattttaaattgacccttagctatagagaatttgctataagctagtcttgtttgtaaaaaaaaaaaaaaaaaaagaaaaagaaaaaagtgtattttactgttttctgtattaagtaattctgtaactgcatggcagtctttttttttttaaataaatatagttgttactggtcctgttgtagcagtgaatatagttaaaatacgtacattaaaaaaaaaattattaggtccttaccagttactgtcctatagctcattcctactagttttcttgacagatttgtattcccagtgtcccgtattgccactcaaattgctctactatgctaagtccttgttaatagtcttaccctccttgaaacacttgaacacttgatgactttagctttgaggagataccatctccaggtgtgctttcttagtctttgcaggcacctcttcccttcaatatctgttcttcgtatttttaaaaaaatttgttttagactgccttgttctgtgtcagctcgctagctgatctcatttccttccatggtttccttaccatttatatgcaaatgactgtcagattcatatctcctttctagatcttccctaattgatgtatctaattgctaacaaatgctctttgctgtctcaggcactacatgtcattgatcttgcccccaatcctgctcctcctctcatgtttcctctttgactaaatggcattaccactaccaaccattcatttgtcctttttaccaattctccaatgctgccattttaattcaggccatcaacctacctaaattatagcaacagcctccttattagtctccctgttttttatttttattcctttctacactacaaccaaattgctccaaaagacttactgatcatgtcactgcattgctttcaccattgctcttagggtacaatacaaatttatcttcatctttaaggtctcagtatgccacttcatctaggaaaccttcattgatgccctctagattaggtgcccttactatccattccctatacaccctgttctttcccagacatacacttggcacactttattgttactgcttattgatcactgctagactgtaagctttgtaagggcagggaccatataagccttgttcactgttatatctctagtgcttagcacaatgcctggcatttcaataaatgtttggacaaacgaatatttgtgtagtgttttacaatttttgaagctctttcacagtcttatttgaccttcacagtcattctgccttagactgtccattgggtaacttttatccacatattactaattgaaaaatgaagacaagt

SEQ ID NO: 304585 - DNA, 5599 bp, Homo sapiens
gcttgcgcgttagagatcgctgtccgctcttcctattggttcgtttttaggagctcggggaatacgaaatatccagccaataggagcagagatgccggaaccgggcttgtgtgcctctgctgaggtgatctggcgcagagcggaggaggtgcttggcgcttctcaggctcctcctctccccttgcggcctttctaacgttggccctgctcttgtggcctcccgcagaatgtggatgacgcccaaaagaagcaagatggaagtcgacgaggctctagttttccggcccgagtggacccagcgttatttggtggtggagcctccggagggcgatggggccctgtgcctggtctgtcgccgcctcatcgtagctacccgcgaacgcgacgtcaggcgccactacgaggctgagcacgaatactacgagcggtatgtggcggacggcgagcgcgcggccctggtggagcgtctgcgtcagggcgacttgcccgtggcctccttcactcctgaagagagagctgctcgtgcaggcctcgggctctgccgcctcttggccttgaagggtcgcggctggggtgagggggactttgtataccagtgcatggaggtgttgctgagagaggtactgcccgagcatgtaagcgtcctgcaaggcgttgacttatctccagatatcacaaggcagaggatcctgagcattgacaggaatctacgcaaccagctttttaaccgagccagggactttaaagcctattctcttgccttggacgaccaggcttttgtggcctatgagaactacctcctggtctttatccgcggtgtaggccctgagttggaggtgcaagaagatcttctgaccataatcaacctgactcatcatttcagtgttggtgcgctcatgtcggcaatcctagagtccctgcagacagcagggcttagcttgcagagaatggttggactgaccacgacccatactttgaggatgattggtgagaactcaggactcgtctcatacatgagagaaaaggccgtaagccccaactgttggaatgtcattcattattcaggatttcttcacttggaactgttgagctcctatgatgtagatgttaatcagatcataaataccatatccgaatggatagttttgattaagaccagaggcgttaggcgacctgaatttcagactttactaacggaatctgaatcagagcatggtgaaagggttaatggacgatgtctgaacaattggcttaggagagggaaaactttaaaactaatattctctctaagaaaagaaatggaagcgttcttggtttcagtaggggcaacaacagtccacttctcagacaaacaatggctttgtgactttggcttcttggtggacattatggaacaccttcgagaactcagtgaagaattacgagttagtaaagtctttgctgctgctgcctttgaccatatttgtactttcgaagttaagctgaatttatttcaaagacatattgaggaaaaaaatctaacagactttcctgccctcagagaagttgttgatgagctaaaacagcaaaataaggaagatgaaaaaatatttgatcctgataggtatcaaatggtgatctgtcgtctccaaaaagaatttgagagacattttaaggacctcaggttcattaaaaaggacttagaacttttttcaaatccatttaactttaaacctgaatatgcacctatttcagtgagggtggagctaacaaaacttcaggcaaacactaatctttggaatgaatacagaatcaaagacttggggcagttttatgctggattgtctgctgaatcctacccaattatcaaaggggttgcctgtaaggtggcatccttgtttgatagtaaccaaatctgtgaaaaggctttttcatatttgactcgaaaccaacacactttgagtcagccattaacagatgagcatctccaagccctgtttcgggttgccacaactgaaatggagcccggttgggatgaccttgtgagagaaagaaatgaatctaatccataaggctttgtagtacaagattgaaaaactcaacaagaatttaattctaaaagcaaaaattggtttgagttttcaagtttactaatttggattgtgagaaagtaccaagtaccagccgtccaaactgatcacaattaaaattctgacagttgccttttttttcatctcaaatggcagcatgggactgaaacatgagaatgccaccttttttaaaacttagtttagtgacaaagtcattgtcttttatgatatagttaattttaaagagatttagtattaatgtgagttgaatttgcagtctgttttttaggtgttctgaagataaatgccaaaaatttcagctcttattttaatggagtgttaaaattctgattcatatagtcttaaattatcaactccttaaatgtgcttttgaaccaatttgcagaagctcacatagcaagttcataagtttccaaaaaggaagcccatacataacagtggaggtgttttgtctaaccatcaaaatgtttgagacttttttttaaacatttctgagttcgaaggtaatactgacagatttcttccctcttccctccccatcacccacctcagtgataacacattactgatagaggaagtcattagaatcatttttaagtttcagatataggagacttcatgcaatttggagataagactaattattgggggttttccttggattttttttttaataactgggggctattttatcagcttgcctattaaaggactatggtaagtatagaatcttaatggttgccagttagtaattctttttttttttttttttactgtagacacaagtttggccctatcaaaaacgatgaggaaaaaagattgcactccaggattaggaggtgtgagatattttagcttttttgtcttatctgcgtgggtattgctgctttattttaaaaaatcctgcctaaagtaaacactttgttttaaaatgatacagtatcagattttgttagatgctagaaatggatttattctaaaatttggaactgtcgtacacattctatatgtaagatagcacacaagtagaaatatttaaaagcagtcttattcacagattgcagtaattctgtatttctactaagataatctgctttgtgccaaaacagtaatttccaaacttctgttcaccatgaaaaggcaatcttaaagttcattatgtaaaactaattataaacaggacccaatttatattcatagatcctctcaagtattatacaatttaaaaactcttgttccaaagtcctgtcttaactattgaaacaccttaatctgtggttactaatccagcaaattcaaggaaccaggctatgactaagaatttaggtggaattgatgtctgggcaattaaaataaatggcataagagcttaaaaaccaaagttgtgccagtggctttcaactagaggcagtaacctgtcattccagaggatgctgagaaatgtgtaggggcacttttttggttgtcatatttactaggggcttctgttggcatttaagcctaaagacactcacccctgcagtgcatgggacagcctggcacaatgaagaattagccctcccaaaatgtagattattttatttcaagggatagggcagattaccattagaagcaaaattaaaagtacaagctgggcaaactgacagaatactagataggagagactaattccaaccttctaaatttggctagtaaagtgcaataaaggcattgataagttctgttagctcaccatagcacttgtaaatcaggaattaataattgaatcagatttaagggctctgtcctgttatacatatttaaggcagaaaaaaagttacatgtcgattaggtacttatcaagaatggtcaagctgagattttggttaatagagtaagcttacatatctagagaaacaacatagtggaaaaccgaaaaaaaaaaacagaaaaatctaccggtaatttcccaatagctttgaatattcacagcagagctttattacttgagagaaagactggaagacctgaaagccacttctgctttctaaccccagttccttaaatattgaaatcttgtacattttgtgaaattccagtatgttttgcttaaggtgttaataaaattagtttgcatcatgtagtcattgagtgagggggagatataagccaaggattttaaattgacccttagctatagagaatttgctataagctagtcttgtttgtaaaaaaaaaaaaaaaaaaagaaaaagaaaaaagtgtattttactgttttctgtattaagtaattctgtaactgcatggcagtctttttttttttaaataaatatagttgttactggtcctgttgtagcagtgaatatagttaaaatacgtacattaaaaaaaaaattattaggtccttaccagttactgtcctatagctcattcctactagttttcttgacagatttgtattcccagtgtcccgtattgccactcaaattgctctactatgctaagtccttgttaatagtcttaccctccttgaaacacttgaacacttgatgactttagctttgaggagataccatctccaggtgtgctttcttagtctttgcaggcacctcttcccttcaatatctgttcttcgtatttttaaaaaaatttgttttagactgccttgttctgtgtcagctcgctagctgatctcatttccttccatggtttccttaccatttatatgcaaatgactgtcagattcatatctcctttctagatcttccctaattgatgtatctaattgctaacaaatgctctttgctgtctcaggcactacatgtcattgatcttgcccccaatcctgctcctcctctcatgtttcctctttgactaaatggcattaccactaccaaccattcatttgtcctttttaccaattctccaatgctgccattttaattcaggccatcaacctacctaaattatagcaacagcctccttattagtctccctgttttttatttttattcctttctacactacaaccaaattgctccaaaagacttactgatcatgtcactgcattgctttcaccattgctcttagggtacaatacaaatttatcttcatctttaaggtctcagtatgccacttcatctaggaaaccttcattgatgccctctagattaggtgcccttactatccattccctatacaccctgttctttcccagacatacacttggcacactttattgttactgcttattgatcactgctagactgtaagctttgtaagggcagggaccatataagccttgttcactgttatatctctagtgcttagcacaatgcctggcatttcaataaatgtttggacaaacgaaaaaaaaaaaaatagcacggaattgaattgaatggaatggaatgcaatggaatctaatgaaacggaaaggaaaggaatggaatggaatggaatgggctggaatggaaaggaatcgcgaatggaatggaatcgaactgaagagactggagtagagaggtggg

SEQ ID NO: 304586 - DNA, 5385 bp, Homo sapiens
gcttgcgcgttagagatcgctgtccgctcttcctattggttcgtttttaggagctcggggaatacgaaatatccagccaataggagcagagatgccggaaccgggcttgtgtgcctctgctgaggtgatctggcgcagagcggaggaggtgcttggcgcttctcaggctcctcctctccccttgcggcctttctaacgttggccctgctcttgtggcctcccgcagaatgtggatgacgcccaaaagaagcaagatggaagtcgacgaggctctagttttccggcccgagtggacccagcgttatttggtggtggagcctccggagggcgatggggccctgtgcctggtctgtcgccgcctcatcgtagctacccgcgaacgcgacgtcaggcgccactacgaggctgagcacgaatactacgagcggtatgtggcggacggcgagcgcgcggccctggtggagcgtctgcgtcagggcgacttgcccgtggcctccttcactcctgaagagagagctgctcgtgcaggcctcgggctctgccgcctcttggccttgaagggtcgcggctggggtgagggggactttgtataccagtgcatggaggtgttgctgagagaggtactgcccgagcatgtaagcgtcctgcaaggcgttgacttatctccagatatcacaaggcagaggatcctgagcattgacaggaatctacgcaaccagctttttaaccgagccagggactttaaagcctattctcttgccttggacgaccaggcttttgtggcctatgagaactacctcctggtctttatccgcggtgtaggccctgagttggaggtgcaagaagatcttctgaccataatcaacctgactcatcatttcagtgttggtgcgctcatgtcggcaatcctagagtccctgcagacagcagggcttagcttgcagagaatggttggactgaccacgacccatactttgaggatgattggtgagaactcaggactcgtctcatacatgagagaaaaggccgtaagccccaactgttggaatgtcattcattattcaggatttcttcacttggaactgttgagctcctatgatgtagatgttaatcagatcataaataccatatccgaatggatagttttgattaagaccagaggcgttaggcgacctgaatttcagactttactaacggaatctgaatcagagcatggtgaaagggttaatggacgatgtctgaacaattggcttaggagagggaaaactttaaaactaatattctctctaagaaaagaaatggaagcgttcttggtttcagtaggggcaacaacagtccacttctcagacaaacaatggctttgtgactttggcttcttggtggacattatggaacaccttcgagaactcagtgaagaattacgagttagtaaagtctttgctgctgctgcctttgaccatatttgtactttcgaagttaagctgaatttatttcaaagacatattgaggaaaaaaatctaacagactttcctgccctcagagaagttgttgatgagctaaaacagcaaaataaggaagatgaaaaaatatttgatcctgataggtatcaaatggtgatctgtcgtctccaaaaagaatttgagagacattttaaggacctcaggttcattaaaaaggacttagaacttttttcaaatccatttaactttaaacctgaatatgcacctatttcagtgagggtggagctaacaaaacttcaggcaaacactaatctttggaatgaatacagaatcaaagacttggggcagttttatgctggattgtctgctgaatcctacccaattatcaaaggggttgcctgtaaggtggcatccttgtttgatagtaaccaaatctgtgaaaaggctttttcatatttgactcgaaaccaacacactttgagtcagccattaacagatgagcatctccaagccctgtttcgggttgccacaactgaaatggagcccggttgggatgaccttgtgagagaaagaaatgaatctaatccataaggctttgtagtacaagattgaaaaactcaacaagaatttaattctaaaagcaaaaattggtttgagttttcaagtttactaatttggattgtgagaaagtaccaagtaccagccgtccaaactgatcacaattaaaattctgacagttgccttttttttcatctcaaatggcagcatgggactgaaacatgagaatgccaccttttttaaaacttagtttagtgacaaagtcattgtcttttatgatatagttaattttaaagagatttagtattaatgtgagttgaatttgcagtctgttttttaggtgttctgaagataaatgccaaaaatttcagctcttattttaatggagtgttaaaattctgattcatatagtcttaaattatcaactccttaaatgtgcttttgaaccaatttgcagaagctcacatagcaagttcataagtttccaaaaaggaagcccatacataacagtggaggtgttttgtctaaccatcaaaatgtttgagacttttttttaaacatttctgagttcgaaggtaatactgacagatttcttccctcttccctccccatcacccacctcagtgataacacattactgatagaggaagtcattagaatcatttttaagtttcagatataggagacttcatgcaatttggagataagactaattattgggggttttccttggattttttttttaataactgggggctattttatcagcttgcctattaaaggactatggtaagtatagaatcttaatggttgccagttagtaattctttttttttttttttttactgtagacacaagtttggccctatcaaaaacgatgaggaaaaaagattgcactccaggattaggaggtgtgagatattttagcttttttgtcttatctgcgtgggtattgctgctttattttaaaaaatcctgcctaaagtaaacactttgttttaaaatgatacagtatcagattttgttagatgctagaaatggatttattctaaaatttggaactgtcgtacacattctatatgtaagatagcacacaagtagaaatatttaaaagcagtcttattcacagattgcagtaattctgtatttctactaagataatctgctttgtgccaaaacagtaatttccaaacttctgttcaccatgaaaaggcaatcttaaagttcattatgtaaaactaattataaacaggacccaatttatattcatagatcctctcaagtattatacaatttaaaaactcttgttccaaagtcctgtcttaactattgaaacaccttaatctgtggttactaatccagcaaattcaaggaaccaggctatgactaagaatttaggtggaattgatgtctgggcaattaaaataaatggcataagagcttaaaggatgctgagaaatgtgtaggggcacttttttggttgtcatatttactaggggcttctgttggcatttaagcctaaagacactcacccctgcagtgcatgggacagcctggcacaatgaagaattagccctcccaaaatgtagattattttatttcaagggatagggcagattaccattagaagcaaaattaaaagtacaagctgggcaaactgacagaatactagataggagagactaattccaaccttctaaatttggctagtaaagtgcaataaaggcattgataagttctgttagctcaccatagcacttgtaaatcaggaattaataattgaatcagatttaagggctctgtcctgttatacatatttaaggcagaaaaaaagttacatgtcgattaggtacttatcaagaatggtcaagctgagattttggttaatagagtaagcttacatatctagagaaacaacatagtggaaaaccgaaaaaaaaaaacagaaaaatctaccggtaatttcccaatagctttgaatattcacagcagagctttattacttgagagaaagactggaagacctgaaagccacttctgctttctaaccccagttccttaaatattgaaatcttgtacattttgtgaaattccagtatgttttgcttaaggtgttaataaaattagtttgcatcatgtagtcattgagtgagggggagatataagccaaggattttaaattgacccttagctatagagaatttgctataagctagtcttgtttgtaaaaaaaaaaaaaaaaaaagaaaaagaaaaaagtgtattttactgttttctgtattaagtaattctgtaactgcatggcagtctttttttttttaaataaatatagttgttactggtcctgttgtagcagtgaatatagttaaaatacgtacattaaaaaaaaaattattaggtccttaccagttactgtcctatagctcattcctactagttttcttgacagatttgtattcccagtgtcccgtattgccactcaaattgctctactatgctaagtccttgttaatagtcttaccctccttgaaacacttgaacacttgatgactttagctttgaggagataccatctccaggtgtgctttcttagtctttgcaggcacctcttcccttcaatatctgttcttcgtatttttaaaaaaatttgttttagactgccttgttctgtgtcagctcgctagctgatctcatttccttccatggtttccttaccatttatatgcaaatgactgtcagattcatatctcctttctagatcttccctaattgatgtatctaattgctaacaaatgctctttgctgtctcaggcactacatgtcattgatcttgcccccaatcctgctcctcctctcatgtttcctctttgactaaatggcattaccactaccaaccattcatttgtcctttttaccaattctccaatgctgccattttaattcaggccatcaacctacctaaattatagcaacagcctccttattagtctccctgttttttatttttattcctttctacactacaaccaaattgctccaaaagacttactgatcatgtcactgcattgctttcaccattgctcttagggtacaatacaaatttatcttcatctttaaggtctcagtatgccacttcatctaggaaaccttcattgatgccctctagattaggtgcccttactatccattccctatacaccctgttctttcccagacatacacttggcacactttattgttactgcttattgatcactgctagactgtaagctttgtaagggcagggaccatataagccttgttcactgttatatctctagtgcttagcacaatgcctggcatttcaataaatgtttggacaaacgaa

SEQ ID NO: 304587 - DNA, 2004 bp, Homo sapiens
gataaagttgcatcgagcttttaaccccacgttgtgccacttggtttcaactacacgcattcccctttttttccttagcctgccgatcaattgtgtctgggcactttttcgtttctcattattctagctagggccatctgtagagttcttaaatccctgtcgacactcacccctgtgtgaatttttctcccagaaacaatgaagaattagccctcccaaaatgtagattattttatttcaagggatagggcagattaccattagaagcaaaattaaaagtacaagctgggcaaactgacagaatactagataggagagactaattccaaccttctaaatttggctagtaaagtgcaataaaggcattgataagttctgttagctcaccatagcacttgtaaatcaggaattaataattgaatcagatttaagggctctgtcctgttatacatatttaaggcagaaaaaaagttacatgtcgattaggtacttatcaagaatggtcaagctgagattttggttaatagagtaagcttacatatctagagaaacaacatagtggaaaaccgaaaaaaaaaaacagaaaaatctaccggtaatttcccaatagctttgaatattcacagcagagctttattacttgagagaaagactggaagacctgaaagccacttctgctttctaaccccagttccttaaatattgaaatcttgtacattttgtgaaattccagtatgttttgcttaaggtgttaataaaattagtttgcatcatgtagtcattgagtgagggggagatataagccaaggattttaaattgacccttagctatagagaatttgctataagctagtcttgtttgtaaaaaaaaaaaaaaaaaaagaaaaagaaaaaagtgtattttactgttttctgtattaagtaattctgtaactgcatggcagtctttttttttttaaataaatatagttgttactggtcctgttgtagcagtgaatatagttaaaatacgtacattaaaaaaaaaattattaggtccttaccagttactgtcctatagctcattcctactagttttcttgacagatttgtattcccagtgtcccgtattgccactcaaattgctctactatgctaagtccttgttaatagtcttaccctccttgaaacacttgaacacttgatgactttagctttgaggagataccatctccaggtgtgctttcttagtctttgcaggcacctcttcccttcaatatctgttcttcgtatttttaaaaaaatttgttttagactgccttgttctgtgtcagctcgctagctgatctcatttccttccatggtttccttaccatttatatgcaaatgactgtcagattcatatctcctttctagatcttccctaattgatgtatctaattgctaacaaatgctctttgctgtctcaggcactacatgtcattgatcttgcccccaatcctgctcctcctctcatgtttcctctttgactaaatggcattaccactaccaaccattcatttgtcctttttaccaattctccaatgctgccattttaattcaggccatcaacctacctaaattatagcaacagcctccttattagtctccctgttttttatttttattcctttctacactacaaccaaattgctccaaaagacttactgatcatgtcactgcattgctttcaccattgctcttagggtacaatacaaatttatcttcatctttaaggtctcagtatgccacttcatctaggaaaccttcattgatgccctctagattaggtgcccttactatccattccctatacaccctgttctttcccagacatacacttggcacactttattgttactgcttattgatcactgctagactgtaagctttgtaagggcagggaccatataagccttgttcactgttatatctctagtgcttagcacaatgcctggcatttcaataaatgtttggacaaacgaa

SEQ ID NO: 304588 - DNA, 478 bp, Homo sapiens
ttcgtggttttgcaaagtattggcctcccccgccataggggccagagcttctgcctccaaaatttcctcccttcatgggtccaaaatttgaagactgattgttgtaattcccaaaatcattgtagcttccaccacctccaaattgctccaaaagacttactgatcatgtcactgcattgctttcaccattgctcttagggtacaatacaaatttatcttcatctttaaggtctcagtatgccacttcatctaggaaaccttcattgatgccctctagattaggtgcccttactatccattccctatacaccctgttctttcccagacatacacttggcacactttattgttactgcttattgatcactgctagactgtaagctttgtaagggcagggaccatataagccttgttcactgttatatctctagtgcttagcacaatgcctggcatttcaataaatgtttggacaaacgaa

SEQ ID NO: 304589 - DNA, 563 bp, Homo sapiens
aacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccaccc

SEQ ID NO: 304590 - DNA, 453 bp, Homo sapiens
tcctctgagtgccagccatggccctgccaaggcccatctcgcttgttatctgcctgatccctgggtcccactatcttgcttagcaacccgaggtgggaatcttggctattcccccatgtggtggggactcaacactccccggtgactctggggaggaggcagcactaggtgctggccttggagcctgccctgaccttgggaagctgggcagcgtgggtggagagagactgctcacacaagcctttgctctgtttgcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccaccc

SEQ ID NO: 304591 - DNA, 517 bp, Homo sapiens
taaactcgcggccgcgtcgactttttttttcgggtggagcatgggacctttattcgttaagacatcaggctccagatatgaactttcagcagaagcgcttgccgggagcaaagggacagaaaggctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcacaatgttctataatcaagctatattcatagtccactttagctaaccgaacaaagcgaatttataaataaaagattctatataatggaagcaataatagtaattaaaagaaataaaagagtacacatgctaccaaca

SEQ ID NO: 304592 - DNA, 223 bp, Homo sapiens
cagaaaagctgagatgaacagtgcctggcagcaatcacagccgggcaagggctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcaggtaaggccccagtggcatcgtggtc

SEQ ID NO: 304593 - DNA, 973 bp, Homo sapiens
aacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgagactttctgaggttgtgctttatttctgctgcgtcgtgggagagggcgggagggtgtcaggggagagtctgcccaggcctcaagggcaggaaaagactccctaaggagctgcagtgcatgcaaggatattttgaatccagactggcacccacgtcacaggaaagcctaggaacactgtaagtgccgcttcctcgggaaagcagaaaaaatacatttcaggtagaagttttcaaaaatcacaagtctttcttggtgaagacagcaagccaataaaactgtcttccaaagtggtcctttatttcacaaccactctcgctactgttcaatacttgtactattcctgggttttgtttctttgtacagtaaacattatgaacaaacaggcaaa

SEQ ID NO: 304594 - DNA, 897 bp, Homo sapiens
taaactcgcggccgcgtcgactttttttttcgggtggagcatgggacctttattcgttaagacatcaggctccagatatgaactttcagcagaagcgcttgccgggagcaaagggacagaaaggctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgagactttctgaggttgtgctttatttctgctgcgtcgtgggagagggcgggagggtgtcaggggagagtctgcccaggcctcaagggcaggaaaagactccctaaggagctgcagtgcatgcaaggatattttgaatccagactggcacccacgtcacaggaaagcctaggaacactgtaagtgccgcttcctcgggaaagcagaaaaaatacatttcaggtagaagttttcaaaaatcacaagtctttcttggtgaagacagcaagccaataaaactgtcttccaaagtggtcctttatttcacaaccactctcgctactgttcaatacttgtactattcctgggttttgtttctttgtacagtaaacattatgaacaaacaggcaaa

SEQ ID NO: 304595 - DNA, 609 bp, Homo sapiens
aacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtcccagcaagggctctggcagctgacagggctttgtctgggacagctctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccaccc

SEQ ID NO: 304596 - DNA, 526 bp, Homo sapiens
ctactactactaaattcgcggccgcgtcgaccattttattgggacattcactttattgtaggggtctggaatcaaaactgcaatatctgtgaggatactgtatacaactaaggtacgttattcacagtagccaagacttgaaaacaacctaagtgtccactggtagataaatggatacacacacacacacacacacacagagcggaacattattcagccttaaaaaggagatctatgtgccaggtgcagtgacttacccctgtaatcccagcactttgggaggccaaggtgggtggactgcttgagcccaggagtttgagaccagcctgggtaacatagtgagaccccgtgtctacagaaaaaaatgttttacaaaataagccacgtgtgatggcacacgcctgtagtcctagctacttgggaggctgaggcgggaggacgacttgattccgggaggtcaagtgactgcagtgagctatgattgcaccactacactccagcctgggtgacagagcaagactctgtc

SEQ ID NO: 304597 - DNA, 2050 bp, Homo sapiens
atataatataaactaataaagatcaggaaataattaatgtataccgtaatgtagaccgactcaggtatgtaagtagagaatatgaaggtgaattagataattaaagggatggtttaacaaaatgaaggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggaaaatacaactgtatattacttagtcttagatgtgcaagaatcggactgttcggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaatcgagagagttgcaagagtgagaggaggggaaggaactggttacttcgtggacttctctgtgcggaactgctccagacaccatttccccagacaccccaatgtctttggattctgcagagcaaatttgttctatgatgtagaagccttggacttggaaagcccgaaaaaccttgtcataaactgtgaagtcttcgaccctcaggaacatgagaacatcaatggtgtaccgcctcatttgggacatcccttccactggggtgggcatgagcgttcttctaccaccaagcctccattcaagccccatggatctagagatcatcatcatccccacaagccacacgaacatggacccccacctcctccagatgaaagagatcactcacatggacccccacttccacaaggccctcctccactattgcccatgtcctgctcaagttgtcaacatgccacttttggcacaaatggggcccaaagacattctcataataataattccagtgacctccatccccataagcatcattcccatgaacagcatccccacggacaccatccccatgcacaccatcctcatgaacatgatacccatagacagcatccccatggacaccacccccatggacaccatcctcatggacaccacccccatggacaccatccccatggacaccatccccactgccatgatttccaagactatggaccttgtgacccaccaccccataaccaaggtcactgttgccatggccacggcccaccacctgggcacttaagaaggcgaggcccaggtaaaggaccctgtcccttccattgcagacaaattggatctgtgtaccgactccctcctctaagaaaaggtgaggtgctgccacttcctgaggccaattttcccagcttcccattgccgcaccacaaacatcctctaaagccagacattcagccctttcctcaatcagtctctgaatcatgtccagggaagttcaagagtgggtttccacaagtttccatgttttttacacatacatttccaaaataaaatgtgattcctttgaagaggaaaatgaataatacattgaattagaaacataaataaaatgaccagtaattgtgaaaattacagttcttttcaacctactttcatactgaagatgcagcaaaatgtgaatgggaaaagagatggcctgagaagagagatcaaatggaaaggagaggaaagaactcagtgctgcctattagtagttaattctgtcactcaccactacatcacttgagacaaatctatgccactcagaatctccttctttcctggacttaactctaattctagagtctctgttactgcttgggctatacctgggcatactaataaagtatggtattgaaacta

SEQ ID NO: 304598 - DNA, 704 bp, Homo sapiens
  misc_feature (5)..(5): n is a, c, g, or t
  misc_feature (648)..(648): n is a, c, g, or t
  misc_feature (653)..(653): n is a, c, g, or t
  misc_feature (655)..(655): n is a, c, g, or t
  misc_feature (662)..(662): n is a, c, g, or t
  misc_feature (704)..(704): n is a, c, g, or t
atccnccgggctgcaggaattggcacgagggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggaaaatacaactgtatattacttagtcttagatgtgcaagaatcggactgttcggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagctctttcagagtggaccgaatcgagagagttgcaagagtgagaggaggggaaggaactggttacttcgtggacttctctgtgcggaactgctccagacaccatttccccagacaccccaatgtctttgattctgagacagattgtctatgtgagaagctngactngnaagccgnctacttgcataactgtgagcttgacctcagacatggacatan

SEQ ID NO: 304599 - DNA, 742 bp, Homo sapiens
  misc_feature (5)..(5): n is a, c, g, or t
  misc_feature (632)..(632): n is a, c, g, or t
  misc_feature (636)..(636): n is a, c, g, or t
  misc_feature (686)..(686): n is a, c, g, or t
  misc_feature (691)..(691): n is a, c, g, or t
  misc_feature (693)..(693): n is a, c, g, or t
  misc_feature (700)..(700): n is a, c, g, or t
  misc_feature (742)..(742): n is a, c, g, or t
atccnccgggctgcaggaattggcacgagggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggaaaatacaactgtatattacttagtcttagatgtgcaagaatcggactgttcggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaatcgagagagttgcaagagtgagagagggagggactgtactcgtgactctctggcggactgctcagcacanttcncagcacccaatgtctttgattctgagacagattgtctatgtgagaagctngactngnaagccgnctacttgcataactgtgagcttgacctcagacatggacatan

SEQ ID NO: 304600 - DNA, 367 bp, Homo sapiens
cttccctcctcttacaataattttagagcgccagaacaagtaggttagctgcaacgactctcttatctaccaccgctacacagtcagacaaattggatctgtgtaccgactccctcctctaagaaaagatgcagcaaaatgtgaatgggaaaagagatggcctgagaagagagatcaaatggaaaggagaggaaagaactcagtgctgcctattagtagttaattctgtcactcaccactacatcacttgagacaaatctatgccactcagaatctccttctttcctggacttaactctaattctagagtctctgttactgcttgggctatacctgggcatactaataaagtatggtattgaaacta

SEQ ID NO: 304601 - DNA, 1899 bp, Homo sapiens
  misc_feature (5)..(5): n is a, c, g, or t
atccnccgggctgcaggaattggcacgagggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaatcgagagagttgcaagagtgagaggaggggaaggaactggttacttcgtggacttctctgtgcggaactgctccagacaccatttccccagacaccccaatgtctttggattctgcagagcaaatttgttctatgatgtagaagccttggacttggaaagcccgaaaaaccttgtcataaactgtgaagtcttcgaccctcaggaacatgagaacatcaatggtgtaccgcctcatttgggacatcccttccactggggtgggcatgagcgttcttctaccaccaagcctccattcaagccccatggatctagagatcatcatcatccccacaagccacacgaacatggacccccacctcctccagatgaaagagatcactcacatggacccccacttccacaaggccctcctccactattgcccatgtcctgctcaagttgtcaacatgccacttttggcacaaatggggcccaaagacattctcataataataattccagtgacctccatccccataagcatcattcccatgaacagcatccccacggacaccatccccatgcacaccatcctcatgaacatgatacccatagacagcatccccatggacaccacccccatggacaccatcctcatggacaccacccccatggacaccatccccatggacaccatccccactgccatgatttccaagactatggaccttgtgacccaccaccccataaccaaggtcactgttgccatggccacggcccaccacctgggcacttaagaaggcgaggcccaggtaaaggaccctgtcccttccattgcagacaaattggatctgtgtaccgactccctcctctaagaaaaggtgaggtgctgccacttcctgaggccaattttcccagcttcccattgccgcaccacaaacatcctctaaagccagacattcagccctttcctcaatcagtctctgaatcatgtccagggaagttcaagagtgggtttccacaagtttccatgttttttacacatacatttccaaaataaaatgtgattcctttgaagaggaaaatgaataatacattgaattagaaacataaataaaatgaccagtaattgtgaaaattacagttcttttcaacctactttcatactgaagatgcagcaaaatgtgaatgggaaaagagatggcctgagaagagagatcaaatggaaaggagaggaaagaactcagtgctgcctattagtagttaattctgtcactcaccactacatcacttgagacaaatctatgccactcagaatctccttctttcctggacttaactctaattctagagtctctgttactgcttgggctatacctgggcatactaataaagtatggtattgaaacta

SEQ ID NO: 304602 - DNA, 1996 bp, Homo sapiens
atataatataaactaataaagatcaggaaataattaatgtataccgtaatgtagaccgactcaggtatgtaagtagagaatatgaaggtgaattagataattaaagggatggtttaacaaaatgaaggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggaaaatacaactgtatattacttagtcttagatgtgcaagaatcggactgttcggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaatcgagagagttgcaagagtgagaggaggggaaggaactggttacttcgtggacttctctgtgcggaactgctccagacaccatttccccagacaccccaatgtctttggattctgcagagcaaatttgttctatgatgtagaagccttggacttggaaagcccgaaaaaccttgtcataaactgtgaagtcttcgaccctcaggaacatgagaacatcaatggtgtaccgcctcatttgggacatcccttccactggggtgggcatgagcgttcttctaccaccaagcctccattcaagccccatggatctagagatcatcatcatccccacaagccacacgaacatggacccccacctcctccagatgaaagagatcactcacatggacccccacttccacaaggccctcctccactattgcccatgtcctgctcaagttgtcaacatgccacttttggcacaaatggggcccaaagacattctcataataataattccagtgacctccatccccataagcatcattcccatgaacagcatccccacggacaccatccccatgcacaccatcctcatgaacatgatacccatagacagcatccccatggacaccacccccatggacaccatcctcatggacaccacccccatggacaccatccccatggacaccatccccactgccatgatttccaagactatggaccttgtgacccaccaccccataaccaaggtcactgttgccatggccacggcccaccacctgggcacttaagaaggcgaggcccaggtaaaggaccctgtcccttccattgcagacaaattggatctgtgtaccgactccctcctctaagaaaaggtgaggtgctgccacttcctgaggccaattttcccagcttcccattgccgcaccacaaacatcctctaaagccagacattcagccctttcctcaatcagtctctgaatcatgtccagggaagttcaagagtgggtttccacaagtttccatgttttttacacatacatttccaaaataaaatgtgattcctttgaagaggaaaatgaataatacattgaattagaaacataaataaaatgaccagtaattgtgaaaattacagttcttttcaacctactttcatactgaagatgcagcaaaatgtgaatgggtgctgcctattagtagttaattctgtcactcaccactacatcacttgagacaaatctatgccactcagaatctccttctttcctggacttaactctaattctagagtctctgttactgcttgggctatacctgggcatactaataaagtatggtattgaaacta

SEQ ID NO: 304603 - DNA, 2303 bp, Homo sapiens
  misc_feature (2163)..(2163): n is a, c, g, or t
  misc_feature (2167)..(2167): n is a, c, g, or t
  misc_feature (2175)..(2175): n is a, c, g, or t
  misc_feature (2182)..(2182): n is a, c, g, or t
  misc_feature (2185)..(2185): n is a, c, g, or t
  misc_feature (2187)..(2187): n is a, c, g, or t
  misc_feature (2189)..(2189): n is a, c, g, or t
  misc_feature (2203)..(2203): n is a, c, g, or t
  misc_feature (2205)..(2206): n is a, c, g, or t
  misc_feature (2210)..(2210): n is a, c, g, or t
  misc_feature (2213)..(2213): n is a, c, g, or t
  misc_feature (2216)..(2216): n is a, c, g, or t
  misc_feature (2218)..(2218): n is a, c, g, or t
  misc_feature (2222)..(2222): n is a, c, g, or t
  misc_feature (2227)..(2227): n is a, c, g, or t
  misc_feature (2235)..(2235): n is a, c, g, or t
  misc_feature (2244)..(2244): n is a, c, g, or t
  misc_feature (2252)..(2252): n is a, c, g, or t
  misc_feature (2266)..(2267): n is a, c, g, or t
  misc_feature (2270)..(2270): n is a, c, g, or t
  misc_feature (2272)..(2272): n is a, c, g, or t
atataatataaactaataaagatcaggaaataattaatgtataccgtaatgtagaccgactcaggtatgtaagtagagaatatgaaggtgaattagataattaaagggatggtttaacaaaatgaaggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggaaaatacaactgtatattacttagtcttagatgtgcaagaatcggactgttcggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaatcgagagagttgcaagagtgagaggaggggaaggaactggttacttcgtggacttctctgtgcggaactgctccagacaccatttccccagacaccccaatgtctttggattctgcagagcaaatttgttctatgatgtagaagccttggacttggaaagcccgaaaaaccttgtcataaactgtgaagtcttcgaccctcaggaacatgagaacatcaatggtgtaccgcctcatttgggacatcccttccactggggtgggcatgagcgttcttctaccaccaagcctccattcaagccccatggatctagagatcatcatcatccccacaagccacacgaacatggacccccacctcctccagatgaaagagatcactcacatggacccccacttccacaaggccctcctccactattgcccatgtcctgctcaagttgtcaacatgccacttttggcacaaatggggcccaaagacattctcataataataattccagtgacctccatccccataagcatcattcccatgaacagcatccccacggacaccatccccatgcacaccatcctcatgaacatgatacccatagacagcatccccatggacaccacccccatggacaccatcctcatggacaccacccccatggacaccatccccatggacaccatccccactgccatgatttccaagactatggaccttgtgacccaccaccccataaccaaggtcactgttgccatggccacggcccaccacctgggcacttaagaaggcgaggcccaggtaaaggaccctgtcccttccattgcagacaaattggatctgtgtaccgactccctcctctaagaaaaggtgaggtgctgccacttcctgaggccaattttcccagcttcccattgccgcaccacaaacatcctctaaagccagacattcagccctttcctcaatcagtctctgaatcatgtccagggaagttcaagagtgggtttccacaagtttccatgttttttacacatacatttccaaaataaaatgtgattcctttgaagaggaaaatgaataatacattgaattagaaacataaataaaatgaccagtaattgtgaaaattacagttcttttcaacctactttcatactgaagatgcagcaaaatgtgaatgggaaaagagatggcctgagaagagagatcaaatggaaaggagaggaaagaactcagtgctgcctattagtagttaattctgtcactcaccactacatcacttgagacaaatctatgccactcagaatctccttctttcctggacttaactctaattctagagtctctgttactgcttgggctatacctgggcatactaataaagtatggtattgaaactaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaaaaaaaaaancttntggccccnttggccnaancnanttttaacttgggcnanntttntcntgngncccnaattngggcctanttggccaantccccctnatggggggggtttnnaantnaatggcccgggtttaaaaacgttggaccggg

SEQ ID NO: 304604 - DNA, 1947 bp, Homo sapiens
atataatataaactaataaagatcaggaaataattaatgtataccgtaatgtagaccgactcaggtatgtaagtagagaatatgaaggtgaattagataattaaagggatggtttaacaaaatgaaggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggaaaatacaactgtatattacttagtcttagatgtgcaagaatcggactgttcggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaatcgagagagttgcaagagtgagaggaggggaaggaactggttacttcgtggacttctctgtgcggaactgctccagacaccatttccccagacaccccaatgtctttggattctgcagagcaaatttgttctatgatgtagaagccttggacttggaaagcccgaaaaaccttgtcataaactgtgaagtcttcgaccctcaggaacatgagaacatcaatggtgtaccgcctcatttgggacatcccttccactggggtgggcatgagcgttcttctaccaccaagcctccattcaagccccatggatctagagatcatcatcatccccacaagccacacgaacatggacccccacctcctccagatgaaagagatcactcacatggacccccacttccacaaggccctcctccactattgcccatgtcctgctcaagttgtcaacatgccacttttggcacaaatggggcccaaagacattctcataataataattccagtgacctccatccccataagcatcattcccatgaacagcatccccacggacaccatccccatgcacaccatcctcatgaacatgatacccatagacagcatccccatggacaccacccccatggacaccatcctcatggacaccacccccatggacaccatccccatggacaccatccccactgccatgatttccaagactatggaccttgtgacccaccaccccataaccaaggtcactgttgccatggccacggcccaccacctgggcacttaagaaggccaattttcccagcttcccattgccgcaccacaaacatcctctaaagccagacattcagccctttcctcaatcagtctctgaatcatgtccagggaagttcaagagtgggtttccacaagtttccatgttttttacacatacatttccaaaataaaatgtgattcctttgaagaggaaaatgaataatacattgaattagaaacataaataaaatgaccagtaattgtgaaaattacagttcttttcaacctactttcatactgaagatgcagcaaaatgtgaatgggaaaagagatggcctgagaagagagatcaaatggaaaggagaggaaagaactcagtgctgcctattagtagttaattctgtcactcaccactacatcacttgagacaaatctatgccactcagaatctccttctttcctggacttaactctaattctagagtctctgttactgcttgggctatacctgggcatactaataaagtatggtattgaaacta

SEQ ID NO: 304605 - DNA, 1983 bp, Homo sapiens
atataatataaactaataaagatcaggaaataattaatgtataccgtaatgtagaccgactcaggtatgtaagtagagaatatgaaggtgaattagataattaaagggatggtttaacaaaatgaaggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggaaaatacaactgtatattacttagtcttagatgtgcaagaatcggactgttcggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaatcgagagagttgcaagagtgagaggaggggaaggaactggttacttcgtggacttctctgtgcggaactgctccagacaccatttccccagacaccccaatgtctttggattctgcagagcaaatttgttctatgatgtagaagccttggacttggaaagcccgaaaaaccttgtcataaactgtgaagtcttcgaccctcaggaacatgagaacatcaatggtgtaccgcctcatttgggacatcccttccactggggtgggcatgagcgttcttctaccaccaagcctccattcaagccccatggatctagagatcatcatcatccccacaagccacacgaacatggacccccacctcctccagatgaaagagatcactcacatggacccccacttccacaaggccctcctccactattgcccatgtcctgctcaagttgtcaacatgccacttttggcacaaatggggcccaaagacattctcataataataattccagtgacctccatccccataagcatcattcccatgaacagcatccccacggcccaccacctgggcacttaagaaggcgaggcccaggtaaaggaccccgtcccttccattgcagacaaattggatctgtgtaccgacatccccatggacaccacccccatggacaccatcctcatggacaccacccccatggacaccatccccatggacaccatccccactgccatgatttccaagactatggaccttgtgacccaccaccccataaccaaggtcactgttgccatggccacggcccaccacctgggcacttaagaaggccaattttcccagcttcccattgccgcaccacaaacatcctctaaagccagacattcagccctttcctcaatcagtctctgaatcatgtccagggaagttcaagagtgggtttccacaagtttccatgttttttacacatacatttccaaaataaaatgtgattcctttgaagaggaaaatgaataatacattgaattagaaacataaataaaatgaccagtaattgtgaaaattacagttcttttcaacctactttcatactgaagatgcagcaaaatgtgaatgggaaaagagatggcctgagaagagagatcaaatggaaaggagaggaaagaactcagtgctgcctattagtagttaattctgtcactcaccactacatcacttgagacaaatctatgccactcagaatctccttctttcctggacttaactctaattctagagtctctgttactgcttgggctatacctgggcatactaataaagtatggtattgaaacta

SEQ ID NO: 304606 - DNA, 2002 bp, Homo sapiens
atataatataaactaataaagatcaggaaataattaatgtataccgtaatgtagaccgactcaggtatgtaagtagagaatatgaaggtgaattagataattaaagggatggtttaacaaaatgaaggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggaaaatacaactgtatattacttagtcttagatgtgcaagaatcggactgttcggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaatcgagagagttgcaagagtgagaggaggggaaggaactggttacttcgtggacttctctgtgcggaactgctccagacaccatttccccagacaccccaatgtctttggattctgcagagcaaatttgttctatgatgtagaagccttggacttggaaagcccgaaaaaccttgtcataaactgtgaagtcttcgaccctcaggaacatgagaacatcaatggtgtaccgcctcatttgggacatcccttccactggggtgggcatgagcgttcttctaccaccaagcctccattcaagccccatggatctagagatcatcatcatccccacaagccacacgaacatggacccccacctcctccagatgaaagagatcactcacatggacccccacttccacaaggccctcctccactattgcccatgtcctgctcaagttgtcaacatgccacttttggcacaaatggggcccaaagacattctcataataataattccagtgacctccatccccataagcatcattcccatgaacagcatccccacggacaccatccccatgcacaccatcctcatgaacatgatacccatagacagcatccccatggacaccacccccatggacaccatcctcatggacaccacccccatggacaccatccccatggacaccatccccactgccatgatttccaagactatggaccttgtgacccaccaccccataaccaaggtcactgttgccatggccacggcccaccacctgggcacttaagaaggcgaggcccaggtaaaggaccctgtcccttccattgcagacaaattggatctgtgtaccgactccctcctctaagaaaaggtgaggtgctgccacttcctgaggccaattttcccagcttcccattgccgcaccacaaacatcctctaaagccagacattcagccctttccacaagtttccatgttttttacacatacatttccaaaataaaatgtgattcctttgaagaggaaaatgaataatacattgaattagaaacataaataaaatgaccagtaattgtgaaaattacagttcttttcaacctactttcatactgaagatgcagcaaaatgtgaatgggaaaagagatggcctgagaagagagatcaaatggaaaggagaggaaagaactcagtgctgcctattagtagttaattctgtcactcaccactacatcacttgagacaaatctatgccactcagaatctccttctttcctggacttaactctaattctagagtctctgttactgcttgggctatacctgggcatactaataaagtatggtattgaaacta

SEQ ID NO: 304607 - DNA, 686 bp, Homo sapiens
  misc_feature (5)..(5): n is a, c, g, or t
  misc_feature (540)..(540): n is a, c, g, or t
  misc_feature (546)..(546): n is a, c, g, or t
  misc_feature (563)..(563): n is a, c, g, or t
  misc_feature (613)..(613): n is a, c, g, or t
  misc_feature (658)..(658): n is a, c, g, or t
  misc_feature (660)..(661): n is a, c, g, or t
  misc_feature (675)..(675): n is a, c, g, or t
  misc_feature (677)..(677): n is a, c, g, or t
  misc_feature (686)..(686): n is a, c, g, or t
atccnccgggctgcaggaattggcacgagggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaatcgagagagttgcaagagtgagagagggaagnactggntactcgtgactctctgncggaactgtcagacacattcccagcacccaatgcttggatctgagacagnttgtctatatgatggacatcatgtgaccgctcattggacatcttncnntggtgcatgacgtntntacacagcn

SEQ ID NO: 304608 - DNA, 837 bp, Homo sapiens
  misc_feature (691)..(691): n is a, c, g, or t
  misc_feature (697)..(697): n is a, c, g, or t
  misc_feature (714)..(714): n is a, c, g, or t
  misc_feature (764)..(764): n is a, c, g, or t
  misc_feature (809)..(809): n is a, c, g, or t
  misc_feature (811)..(812): n is a, c, g, or t
  misc_feature (826)..(826): n is a, c, g, or t
  misc_feature (828)..(828): n is a, c, g, or t
  misc_feature (837)..(837): n is a, c, g, or t
atataatataaactaataaagatcaggaaataattaatgtataccgtaatgtagaccgactcaggtatgtaagtagagaatatgaaggtgaattagataattaaagggatggtttaacaaaatgaaggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggaaaatacaactgtatattacttagtcttagatgtgcaagaatcggactgttcggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaatcgagagagttgcaagagtgagagagggaagnactggntactcgtgactctctgncggaactgtcagacacattcccagcacccaatgcttggatctgagacagnttgtctatatgatggacatcatgtgaccgctcattggacatcttncnntggtgcatgacgtntntacacagcn

SEQ ID NO: 304609 - DNA, 1140 bp, Homo sapiens
aggtttatacaacacatatacagacgtgagtactttataataacacgccccagtaccaaagctatagttcagcctttttcattatgaatgcccacatgcgcatacattgaatggtggcgccctgtgatgttcgctttggtgatgctgacgttagaggacaaggacatgaagggattctcctgggccatagtcccagccttaacctccctaggctacctgattatactggtggtctccatctttcccttctgggtgcgactgacaaacgaggagtcccacgaagtctttttcagtggcctatttgagaactgcttcaatgccaaatgctggaagcctcgacccttatccagggcctgtgccttcctggctttggtgctgcatgccctggagatcaaggctctgaggatgaagctcggccccctgcagttctccgtgctgtggccttactacgtgctgggcttcggcatctttctgttcatagtggctggtaccatctgcctcattcaagaaatggtttgcccttgctggcacttgttgtccacttcccagagtatggaggaggaccacgggagcctgtacctggacaatctggagagtttgggaggagaaccgagctcagtacaaaaggagacacaggtgacagcagaaacagtcatctagcccaggacatggcttctttacccttcttcaagccatgtgagtgtacacatgtagctgtttgtagtcctccccaccctctctgccagtatctgtgcctttgaggagcttcttgcgtgtcagatcaactctccacctccccatactcacagtgattctatcttgcttgtatgtgaaatttgctaaaagtcctttcaactcttctgagcttcctaagtgacgtttttgcaggtattttcaataaaaagaagggctactttgttcatccatatctcaaaaaccaagtccgcagggcaggaggggagggaggaatattacaagataaccaagtgaaatgggattttgtgaaacagaaaccgtacagaatacagaatatactcgggggaatgacaactatttgggctggtggcacaggggtaaaagaatttaccaagacggttgtagataaagaaaggcagatttattaaaggaagtataaaagta

SEQ ID NO: 304610 - DNA, 562 bp, Homo sapiens
ggtgacctagattaccacgcaactgattggggtctagtataacatgtgcacggatacattgccacatcccatttccttctctatgagcaggatttccaatttccaagcctgatgggatctcccagctggaacaggatctacaggtctttgatctggaaactaagactagagaagtcttaagagatgactgctcaggtgagtaaggcagaatcagatagaattagtagggaagtaaagttcaattgttgagccaagttgtagctgctttggcactcagaatgaagagctctgtgtgtgtcctagcatggagagttccttccttttcccttcagttaggttgaccctttccatttgtttagtatccgtgcacatgtcgtactagaccccaatcaagttgcttatctaaaattctttcagctgtttccctattatttccttactctgctgaacatgtccgctgttttacctcactgctcctgtttatgcccttaacttctgctgttgagattttgtgcctgtttttcagagtaaataaacttttcttgtccttgtagatactaca

SEQ ID NO: 304611 - DNA, 1594 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggagtttgtgacattcgaggatgtggctgtgcaccttactcgagaggaatggggatacctggaccctgttcagagggacctctacagagaagtgatgttagagaattatgggaacgtggtctcactgggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaaaaaaaaaac

SEQ ID NO: 304612 - DNA, 5342 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggtgagctgaggaaccctctgcttttcctcagggactattgctactgatggagtgtggcctctctctcatcccatctgtagaccttgcctggaatttttttcaatagcagactccagtttgggaattgatcctcttcggagacctggacttcacataaaccaacttcccatctccccagtgccatgagcaaactctgttttctctttgtccatggttgtgtgatgggtgcttattagatgtttaagggttatgggctttattccgtaggttctaatctgttctccctcctcctcaacgtaagtacacagtggataccctctctatgatcttcattctctggccatggtgctacagtgttctcattcctcagagcagccaggatgtgttatttcaggagtttgtgacattcgaggatgtggctgtgcaccttactcgagaggaatggggatacctggaccctgttcagagggacctctacagagaagtgatgttagagaattatgggaacgtggtctcactggatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacgcctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctga

SEQ ID NO: 304613 - DNA, 4840 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggatttccaatttccaagcctgatgggatctcccagctggaacaggatctacaggtctttgatctggaaactaagactagagaagtcttaagagatgactgctcagatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacgcctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctga

SEQ ID NO: 304614 - DNA, 4735 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacgcctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctga

SEQ ID NO: 304615 - DNA, 5178 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggagtttgtgacattcgaggatgtggctgtgcaccttactcgagaggaatggggatacctggaccctgttcagagggacctctacagagaagtgatgttagagaattatgggaacgtggtctcactggatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacgcctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctga

SEQ ID NO: 304616 - DNA, 5058 bp, Homo sapiens
atgaagataaagtgaaatacaagctttcctaagaaaatcctgtatcacaggtcaaaacacgcataaggcatgcaagtactgagacgaagcagagtagacacacccaatacctgaaaaatgttcattggttttactagagtattgaggagggtcctgctgacaccccttgggctggagaggcctcctctgaaagggagccctgggaaagggctgctctcactcttcactcctttctcctccctcagctccacctgttcctcaggtgcctgctcttccccgtgagggaagcccaggagaccaggcagctgcgctcttgacagccaggtaccaggtgagctgaggaaccctctgcttttcctcagggactattgctactgatggagtgtggcctctctctcatcccatctgtagaccttgcctggaatttttttcaatagcagactccagtttgggaattgatcctcttcggagacctggacttcacataaaccaacttcccatctccccagtgccatgagcaaactctgttttctctttgtccatggttgtgtgatgggtgcttattagatgtttaagggttatgggctttattccgtaggttctaatctgttctccctcctcctcaacgtaagtacacagtggataccctctctatgatcttcattctctggccatggtgctacagtgttctcattcctcagagcagccaggatgtgttatttcaggagtttgtgacattcgaggatgtggctgtgcaccttactcgagaggaatggggatacctggaccctgttcagagggacctctacagagaagtgatgttagagaattatgggaacgtggtctcactggatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacgcctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctga

SEQ ID NO: 304617 - DNA, 5572 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggtgagctgaggaaccctctgcttttcctcagggactattgctactgatggagtgtggcctctctctcatcccatctgtagaccttgcctggaatttttttcaatagcagactccagtttgggaattgatcctcttcggagacctggacttcacataaaccaacttcccatctccccagtgccatgagcaaactctgttttctctttgtccatggttgtgtgatgggtgcttattagatgtttaagggttatgggctttattccgtaggttctaatctgttctccctcctcctcaacgtaagtacacagtggataccctctctatgatcttcattctctggccatggtgctacagtgttctcattcctcagagcagccaggatgtgttatttcaggagtttgtgacattcgaggatgtggctgtgcaccttactcgagaggaatggggatacctggaccctgttcagagggacctctacagagaagtgatgttagagaattatgggaacgtggtctcactggatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacgcctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctga

SEQ ID NO: 304618 - DNA, 5070 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggatttccaatttccaagcctgatgggatctcccagctggaacaggatctacaggtctttgatctggaaactaagactagagaagtcttaagagatgactgctcagatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacgcctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctga

SEQ ID NO: 304619 - DNA, 3849 bp, Homo sapiens
  misc_feature (21)..(21): n is a, c, g, or t
aggctagtacgaggcgggggngtggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacgcctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctga

SEQ ID NO: 304620 - DNA, 5543 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggtgagctgaggaaccctctgcttttcctcagggactattgctactgatggagtgtggcctctctctcatcccatctgtagaccttgcctggaatttttttcaatagcagactccagtttgggaattgatcctcttcggagacctggacttcacataaaccaacttcccatctccccagtgccatgagcaaactctgttttctctttgtccatggttgtgtgatgggtgcttattagatgtttaagggttatgggctttattccgtaggttctaatctgttctccctcctcctcaacgtaagtacacagtggataccctctctatgatcttcattctctggccatggtgctacagtgttctcattcctcagagcagccaggatgtgttatttcaggagtttgtgacattcgaggatgtggctgtgcaccttactcgagaggaatggggatacctggaccctgttcagagggacctctacagagaagtgatgttagagaattatgggaacgtggtctcactggatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacgcctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctgaaaaaaccatgcaatgtcaaaagtttcgggggcttgccccacgactctttctaacccctgcttggtgcgcgcggccccacattactgaaactggagccaactgccaggcaccccggctcaccaagtgtcgtgcccccaaaaaccccgggccgggttgaaaccagagtcggggcacggctacacggccgcgctaaaccccccg

SEQ ID NO: 304621 - DNA, 4190 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggtgagctgaggaaccctctgcttttcctcagggactattgctactgatggagtgtggcctctctctcatcccatctgtagaccttgcctggaatttttttcaatagcagactccagtttgggaattgatcctcttcggagacctggacttcacataaaccaacttcccatctccccagtgccatgagcaaactctgttttctctttgtccatggttgtgtgatgggtgcttattagatgtttaagggttatgggctttattccgtaggttctaatctgttctccctcctcctcaacgtaagtacacagtggataccctctctatgatcttcattctctggccatggtgctacagtgttctcattcctcagagcagccaggatgtgttatttcaggagtttgtgacattcgaggatgtggctgtgcaccttactcgagaggaatggggatacctggaccctgttcagagggacctctacagagaagtgatgttagagaattatgggaacgtggtctcactggatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagagcaggactctctctcaaaaaaacacaaaaaaacaaaaacaacttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctga

SEQ ID NO: 304622 - DNA, 5607 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggtgagctgaggaaccctctgcttttcctcagggactattgctactgatggagtgtggcctctctctcatcccatctgtagaccttgcctggaatttttttcaatagcagactccagtttgggaattgatcctcttcggagacctggacttcacataaaccaacttcccatctccccagtgccatgagcaaactctgttttctctttgtccatggttgtgtgatgggtgcttattagatgtttaagggttatgggctttattccgtaggttctaatctgttctccctcctcctcaacgtaagtacacagtggataccctctctatgatcttcattctctggccatggtgctacagtgttctcattcctcagagcagccaggatgtgttatttcaggagtttgtgacattcgaggatgtggctgtgcaccttactcgagaggaatggggatacctggaccctgttcagagggacctctacagagaagtgatgttagagaattatgggaacgtggtctcactggatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacgcctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctgaagaacaacacaaacacaacacaagaaaacaaaaaatttggtcggcggcgcgggccctgagaaaaggtttttcaacccaactttgtggggcgcgcggcccagatggtagtgccacctgggcaaacgcggtacaaaggaaaatctggccagagactatggggtgggttcccccaaaaaaagccgggcgcacggggtttgaacaaccacaggggttcgggcctacggcttaccaaggtccagggcgtagccgcccggccacggggggg

SEQ ID NO: 304623 - DNA, 5440 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggtgagctgaggaaccctctgcttttcctcagggactattgctactgatggagtgtggcctctctctcatcccatctgtagaccttgcctggaatttttttcaatagcagactccagtttgggaattgatcctcttcggagacctggacttcacataaaccaacttcccatctccccagtgccatgagcaaactctgttttctctttgtccatggttgtgtgatgggtgcttattagatgtttaagggttatgggctttattccgtaggttctaatctgttctccctcctcctcaacgtaagtacacagtggataccctctctatgatcttcattctctggccatggtgctacagtgttctcattcctcagagcagccaggatgtgttatttcaggagtttgtgacattcgaggatgtggctgtgcaccttactcgagaggaatggggatacctggaccctgttcagagggacctctacagagaagtgatgttagagaattatgggaacgtggtctcactggatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacgcctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctgataaaaaaaaaatcacctctatttcttccctatccttcaaacaaaaataaaaccttgggtgcagggttcctaacttgattttcaattggcccgggagaa

SEQ ID NO: 304624 - DNA, 1824 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggagtttgtgacattcgaggatgtggctgtgcaccttactcgagaggaatggggatacctggaccctgttcagagggacctctacagagaagtgatgttagagaattatgggaacgtggtctcactgggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaaaaaaaaaac

SEQ ID NO: 304625 - DNA, 1611 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaaaaaaaaaac

SEQ ID NO: 304626 - DNA, 1508 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggagtttgtgacattcgaggatgtggctgtgcaccttactcgagaggaatggggatacctggaccctgttcagagggacctctacagagaagtgatgttagagaattatgggaacgtggtctcactgggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaaaaaaaaaac

SEQ ID NO: 304627 - DNA, 1673 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggagtttgtgacattcgaggatgtggctgtgcaccttactcgagaggaatggggatacctggaccctgttcagagggacctctacagagaagtgatgttagagaattatgggaacgtggtctcactgggtacagtgggaagctgggattagccaagctgtagtgctgctgggaagcatcagtggggtttgtcggcagctcccttggtgcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaaaaaaaaaac

SEQ ID NO: 304628 - DNA, 1381 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaaaaaaaaaac

SEQ ID NO: 304629 - DNA, 949 bp, Homo sapiens
cagcggaacaagcaagaaactaaagaaaaaggaggcaggctgcccactgggacggtttttagtgtgttttccattcctggctctttaatctttgtaggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaaaaaaaaaac

SEQ ID NO: 304630 - DNA, 1019 bp, Homo sapiens
cttttttttttttccgttggctttgtctatgctggtggcatccagggcattgctttgtctccctgattatgctcaggattcaaggtcttcttatttgtggggaggcaggctgcccactgggacggtttttagtgtgttttccattcctggctctttaatctttgtaggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaaaaaaaaaac

SEQ ID NO: 304631 - DNA, 1413 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggaggggacctctacagagaagtgatgttagagaattatgggaacgtggtctcactgggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaaaaaaaaaac

SEQ ID NO: 304632 - DNA, 924 bp, Homo sapiens
tctgagtgagaacagaggggaagctctagagagtcgtgatttgaaagactcttgcgaacgtggtctcactgggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaaaaaaaaaac

SEQ ID NO: 304633 - DNA, 4833 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggtgagctgaggaaccctctgcttttcctcagggactattgctactgatggagtgtggcctctctctcatcccatctgtagaccttgcctggaatttttttcaatagcagactccagtttgggaattgatcctcttcggagacctggacttcacataaaccaacttcccatctccccagtgccatgagcaaactctgttttctctttgtccatggttgtgtgatgggtgcttattagatgtttaagggttatgggctttattccgtaggttctaatctgttctccctcctcctcaacgtaagtacacagtggataccctctctatgatcttcattctctggccatggtgctacagtgttctcattcctcagagcagccaggatgtgttatttcaggagtttgtgacattcgaggatgtggctgtgcaccttactcgagaggaatggggatacctggaccctgttcagagggacctctacagagaagtgatgttagagaattatgggaacgtggtctcactggatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacgcctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccatgtggcaacacagctagtgatccatgatagtcgtacagcgagatacggtaacgccatcattggctcatagtacatgagcacagtgctgactgacgttgatatatttatgggcacatcgtaaaaatgttaaacacgctgtc

SEQ ID NO: 304634 - DNA, 1540 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggagtttgtgacattcgaggatgtggctgtgcaccttactcgagaggaatggggatacctggaccctgttcagagggacctctacagagaagtgatgttagagaattatgggaacgtggtctcactgggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaaaaaaaaaac

SEQ ID NO: 304635 - DNA, 1435 bp, Homo sapiens
agcaggggcgcggtggagcctggagtggagggcgagggtcccaccgtgacccgcctggagggcagcccagctctgggacgcgaaaccgcctacgacggtgccagttccaagagcctctgagttcctgccttttttcatctctgaatccccaccattggcctacattgggagtggggcgacctatggggaaagcaaggtcctgagactctgagcaacttccccaagatcacacagctaggaagtgatgaagctgagacaagaccagccagcacttacccaccacggtgtgatgctgacgttagaggacaaggacatgaagggattctcctgggccatagtcccagccttaacctccctaggctacctgattatactggtggtctccatctttcccttctgggtgcgactgacaaacgaggagtcccacgaagtctttttcagtggcctatttgagaactgcttcaatgccaaatgctggaagcctcgacccttatccatttacatcatcctcggccgggttttcctgctctctgcagttttcttggctttcgtcaccaccttcatcatgatgccctttgcatccgagttcttcccgaggacctggaagcaaaactttgtgttagcctgcatcagcttcttcacaggggcctgtgccttcctggctttggtgctgcatgccctggagatcaaggctctgaggatgaagctcggccccctgcagttctccgtgctgtggccttactacgtgctgggcttcggcatctttctgttcatagtggctggtaccatctgcctcattcaagaaatggtttgcccttgctggcacttgttgtccacttcccagagtatggaggaggaccacgggagcctgtacctggacaatctggagagtttgggaggagaaccgagctcagtacaaaaggagacacaggtgacagcagaaacagtcatctagcccaggacatggcttctttacccttcttcaagccatgtgagtgtacacatgtagctgtttgtagtcctccccaccctctctgccagtatctgtgcctttgaggagcttcttgcgtgtcagatcaactctccacctccccatactcacagtgattctatcttgcttgtatgtgaaatttgctaaaagtcctttcaactcttctgagcttcctaagtgacgtttttgcaggtattttcaataaaaagaagggctactttgttcatccatatctcaaaaaccaagtccgcagggcaggaggggagggaggaatattacaagataaccaagtgaaatgggattttgtgaaacagaaaccgtacagaatacagaatatactcgggggaatgacaactatttgggctggtggcacaggggtaaaagaatttaccaagacggttgtagataaagaaaggcagatttattaaaggaagtataaaagta

SEQ ID NO: 304636 - DNA, 2152 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggattagaagcccaggacccaggaaggagacacaggaaatttattcaaagtccccacgctgcagttccaagagcctctgagttcctgccttttttcatctctgaatccccaccattggcctacattgggagtggggcgacctatggggaaagcaaggtcctgagactctgagcaacttccccaagatcacacagctaggaagtgatgaagctgagacaagaccagccagcacttacccaccacggtgtgatgctgacgttagaggacaaggacatgaagggattctcctgggccatagtcccagccttaacctccctaggctacctgattatactggtggtctccatctttcccttctgggtgcgactgacaaacgaggagtcccacgaagtctttttcagtggcctatttgagaactgcttcaatgccaaatgctggaagcctcgacccttatccatttacatcatcctcggccgggttttcctgctctctgcagttttcttggctttcgtcaccaccttcatcatgatgccctttgcatccgagttcttcccgaggacctggaagcaaaactttgtgttagcctgcatcagcttcttcacaggggcctgtgccttcctggctttggtgctgcatgccctggagatcaaggctctgaggatgaagctcggccccctgcagttctccgtgctgtggccttactacgtgctgggcttcggcatctttctgttcatagtggctggtaccatctgcctcattcaagaaatggtttgcccttgctggcacttgttgtccacttcccagagtatggaggaggaccacgggagcctgtacctggacaatctggagagtttgggaggagaaccgagctcagtacaaaaggagacacaggtgacagcagaaacagtcatctagcccaggacatggcttctttacccttcttcaagccatgtgagtgtacacatgtagctgtttgtagtcctccccaccctctctgccagtatctgtgcctttgaggagcttcttgcgtgtcagatcaactctccacctccccatactcacagtgattctatcttgcttgtatgtgaaatttgctaaaagtcctttcaactcttctgagcttcctaagtgacgtttttgcaggtattttcaataaaaagaagggctactttgttcatccatatctcaaaaaccaagtccgcagggcaggaggggagggaggaatattacaagataaccaagtgaaatgggattttgtgaaacagaaaccgtacagaatacagaatatactcgggggaatgacaactatttgggctggtggcacaggggtaaaagaatttaccaagacggttgtagataaagaaaggcagatttattaaaggaagtataaaagta

SEQ ID NO: 304637 - DNA, 2048 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggattagaagcccaggacccaggaaggagacacaggaaatttattcaaagtccccacgctgcagttccaagagcctctgagttcctgccttttttcatctctgaatccccaccattggcctacattgggagtggggcgacctgtgatgctgacgttagaggacaaggacatgaagggattctcctgggccatagtcccagccttaacctccctaggctacctgattatactggtggtctccatctttcccttctgggtgcgactgacaaacgaggagtcccacgaagtctttttcagtggcctatttgagaactgcttcaatgccaaatgctggaagcctcgacccttatccatttacatcatcctcggccgggttttcctgctctctgcagttttcttggctttcgtcaccaccttcatcatgatgccctttgcatccgagttcttcccgaggacctggaagcaaaactttgtgttagcctgcatcagcttcttcacaggggcctgtgccttcctggctttggtgctgcatgccctggagatcaaggctctgaggatgaagctcggccccctgcagttctccgtgctgtggccttactacgtgctgggcttcggcatctttctgttcatagtggctggtaccatctgcctcattcaagaaatggtttgcccttgctggcacttgttgtccacttcccagagtatggaggaggaccacgggagcctgtacctggacaatctggagagtttgggaggagaaccgagctcagtacaaaaggagacacaggtgacagcagaaacagtcatctagcccaggacatggcttctttacccttcttcaagccatgtgagtgtacacatgtagctgtttgtagtcctccccaccctctctgccagtatctgtgcctttgaggagcttcttgcgtgtcagatcaactctccacctccccatactcacagtgattctatcttgcttgtatgtgaaatttgctaaaagtcctttcaactcttctgagcttcctaagtgacgtttttgcaggtattttcaataaaaagaagggctactttgttcatccatatctcaaaaaccaagtccgcagggcaggaggggagggaggaatattacaagataaccaagtgaaatgggattttgtgaaacagaaaccgtacagaatacagaatatactcgggggaatgacaactatttgggctggtggcacaggggtaaaagaatttaccaagacggttgtagataaagaaaggcagatttattaaaggaagtataaaagta

SEQ ID NO: 304638 - DNA, 1331 bp, Homo sapiens
agcaggggcgcggtggagcctggagtggagggcgagggtcccaccgtgacccgcctggagggcagcccagctctgggacgcgaaaccgcctacgacggtgccagttccaagagcctctgagttcctgccttttttcatctctgaatccccaccattggcctacattgggagtggggcgacctgtgatgctgacgttagaggacaaggacatgaagggattctcctgggccatagtcccagccttaacctccctaggctacctgattatactggtggtctccatctttcccttctgggtgcgactgacaaacgaggagtcccacgaagtctttttcagtggcctatttgagaactgcttcaatgccaaatgctggaagcctcgacccttatccatttacatcatcctcggccgggttttcctgctctctgcagttttcttggctttcgtcaccaccttcatcatgatgccctttgcatccgagttcttcccgaggacctggaagcaaaactttgtgttagcctgcatcagcttcttcacaggggcctgtgccttcctggctttggtgctgcatgccctggagatcaaggctctgaggatgaagctcggccccctgcagttctccgtgctgtggccttactacgtgctgggcttcggcatctttctgttcatagtggctggtaccatctgcctcattcaagaaatggtttgcccttgctggcacttgttgtccacttcccagagtatggaggaggaccacgggagcctgtacctggacaatctggagagtttgggaggagaaccgagctcagtacaaaaggagacacaggtgacagcagaaacagtcatctagcccaggacatggcttctttacccttcttcaagccatgtgagtgtacacatgtagctgtttgtagtcctccccaccctctctgccagtatctgtgcctttgaggagcttcttgcgtgtcagatcaactctccacctccccatactcacagtgattctatcttgcttgtatgtgaaatttgctaaaagtcctttcaactcttctgagcttcctaagtgacgtttttgcaggtattttcaataaaaagaagggctactttgttcatccatatctcaaaaaccaagtccgcagggcaggaggggagggaggaatattacaagataaccaagtgaaatgggattttgtgaaacagaaaccgtacagaatacagaatatactcgggggaatgacaactatttgggctggtggcacaggggtaaaagaatttaccaagacggttgtagataaagaaaggcagatttattaaaggaagtataaaagta

SEQ ID NO: 304639 - DNA, 1989 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggcagttccaagagcctctgagttcctgccttttttcatctctgaatccccaccattggcctacattgggagtggggcgacctgtgatgctgacgttagaggacaaggacatgaagggattctcctgggccatagtcccagccttaacctccctaggctacctgattatactggtggtctccatctttcccttctgggtgcgactgacaaacgaggagtcccacgaagtctttttcagtggcctatttgagaactgcttcaatgccaaatgctggaagcctcgacccttatccatttacatcatcctcggccgggttttcctgctctctgcagttttcttggctttcgtcaccaccttcatcatgatgccctttgcatccgagttcttcccgaggacctggaagcaaaactttgtgttagcctgcatcagcttcttcacaggggcctgtgccttcctggctttggtgctgcatgccctggagatcaaggctctgaggatgaagctcggccccctgcagttctccgtgctgtggccttactacgtgctgggcttcggcatctttctgttcatagtggctggtaccatctgcctcattcaagaaatggtttgcccttgctggcacttgttgtccacttcccagagtatggaggaggaccacgggagcctgtacctggacaatctggagagtttgggaggagaaccgagctcagtacaaaaggagacacaggtgacagcagaaacagtcatctagcccaggacatggcttctttacccttcttcaagccatgtgagtgtacacatgtagctgtttgtagtcctccccaccctctctgccagtatctgtgcctttgaggagcttcttgcgtgtcagatcaactctccacctccccatactcacagtgattctatcttgcttgtatgtgaaatttgctaaaagtcctttcaactcttctgagcttcctaagtgacgtttttgcaggtattttcaataaaaagaagggctactttgttcatccatatctcaaaaaccaagtccgcagggcaggaggggagggaggaatattacaagataaccaagtgaaatgggattttgtgaaacagaaaccgtacagaatacagaatatactcgggggaatgacaactatttgggctggtggcacaggggtaaaagaatttaccaagacggttgtagataaagaaaggcagatttattaaaggaagtataaaagta

SEQ ID NO: 304640 - DNA, 1901 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggattagaagcccaggacccaggaaggagacacaggaaatttattcaaagtccccacgctgcagttccaagagcctctgagttcctgccttttttcatctctgaatccccaccattggcctacattgggagtggggcgacctgtgatgctgacgttagaggacaaggacatgaagggattctcctgggccatagtcccagccttaacctccctaggctacctgattatactggtggtctccatctttcccttctgggtgcgactgacaaacgaggagtcccacgaagtctttttcagtggcctatttgagaactgcttcaatgccaaatgctggaagcctcgacccttatccagggcctgtgccttcctggctttggtgctgcatgccctggagatcaaggctctgaggatgaagctcggccccctgcagttctccgtgctgtggccttactacgtgctgggcttcggcatctttctgttcatagtggctggtaccatctgcctcattcaagaaatggtttgcccttgctggcacttgttgtccacttcccagagtatggaggaggaccacgggagcctgtacctggacaatctggagagtttgggaggagaaccgagctcagtacaaaaggagacacaggtgacagcagaaacagtcatctagcccaggacatggcttctttacccttcttcaagccatgtgagtgtacacatgtagctgtttgtagtcctccccaccctctctgccagtatctgtgcctttgaggagcttcttgcgtgtcagatcaactctccacctccccatactcacagtgattctatcttgcttgtatgtgaaatttgctaaaagtcctttcaactcttctgagcttcctaagtgacgtttttgcaggtattttcaataaaaagaagggctactttgttcatccatatctcaaaaaccaagtccgcagggcaggaggggagggaggaatattacaagataaccaagtgaaatgggattttgtgaaacagaaaccgtacagaatacagaatatactcgggggaatgacaactatttgggctggtggcacaggggtaaaagaatttaccaagacggttgtagataaagaaaggcagatttattaaaggaagtataaaagta

SEQ ID NO: 304641 - DNA, 1548 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggcagttccaagagcctctgagttcctgccttttttcatctctgaatccccaccattggcctacattgggagtggggcgaccttttacatcatcctcggccgggttttcctgctctctgcagttttcttggctttcgtcaccaccttcatcatgatgccctttgcatccgagttcttcccgaggacctggaagcaaaactttgtgttagcctgcatcagcttcttcacaggggcctgtgccttcctggctttggtgctgcatgccctggagatcaaggctctgaggatgaagctcggccccctgcagttctccgtgctgtggccttactacgtgctgggcttcggcatctttctgttcatagtggctggtaccatctgcctcattcaagaaatggtttgcccttgctggcacttgttgtccacttcccagagtatggaggaggaccacgggagcctgtacctggacaatctggagagtttgggaggagaaccgagctcagtacaaaaggagacacaggtgacagcagaaacagtcatctagcccaggacatggcttctttacccttcttcaagccatgtgagtgtacacatgtagctgtttgtagtcctccccaccctctctgccagtatctgtgcctttgaggagcttcttgcgtgtcagatcaactctccacctccccatactcacagtgattctatcttgcttgtatgtgaaatttgctaaaagtcctttcaactcttctgagcttcctaagtgacgtttttgcaggtattttcaataaaaagaagggctactttgttcatccatatctcaaaaaccaagtccgcagggcaggaggggagggaggaatattacaagataaccaagtgaaatgggattttgtgaaacagaaaccgtacagaatacagaatatactcgggggaatgacaactatttgggctggtggcacaggggtaaaagaatttaccaagacggttgtagataaagaaaggcagatttattaaaggaagtataaaagta

SEQ ID NO: 304642 - DNA, 2486 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggtgagctgaggaaccctctgcttttcctcagggactattgctactgatggagtgtggcctctctctcatcccatctgtagaccttgcctggaatttttttcaatagcagactccagtttgggaattgatcctcttcggagacctggacttcacataaaccaacttcccatctccccagtgccatgagcaaactctgttttctctttgtccatggttgtgtgatgggtgcttattagatgtttaagggttatgggctttattccgtaggttctaatctgttctccctcctcctcaacgtaagtacacagtggataccctctctatgatcttcattctctggccatggtgctacagtgttctcattcctcagagcagccaggatgtgttatttcaggagtttgtgacattcgaggatgtggctgtgcaccttactcgagaggaatggggatacctggaccctgttcagagggacctctacagagaagtgatgttagagaattatgggaacgtggtctcactggatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatggcaacaacttcgtccaccaggacctgtgtatgtatgcacacgccgagcacccaaacctgtgtcaccaagggttttgggtgaagtcagtatggacgaagttgttgcgcaacaacttcgtccatccgatctgcaacaacttcgtccatacggacctgtgtcaccacgggtttggc

SEQ ID NO: 304643 - DNA, 1647 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggtgagctgaggaaccctctgcttttcctcagggactattgctactgatggagtgtggcctctctctcatcccatctgtagaccttgcctggaatttttttcaatagcagactccagtttgggaattgatcctcttcggagacctggacttcacataaaccaacttcccatctccccagtgccatgagcaaactctgttttctctttgtccatggttgtgtgatgggtgcttattagatgtttaagggttatgggctttattccgtaggttctaatctgttctccctcctcctcaacgtaagtacacagtggataccctctctatgatcttcattctctggccatggtgctacagtgttctcattcctcagagcagccaggatgtgttatttcaggagtttgtgacattcgaggatgtggctgtgcaccttactcgagaggaatggggatacctggaccctgttcagagggacctctacagagaagtgatgttagagaattatgggaacgtggtctcactgggtaaggacttccttattattcggtttatctatttgaatttctttactttcttgtttcttcctaagtataaggtctctgagaaggtctgtagagtgtggcttagattccaggacttagaacctctgaatccttatctttcacatcgtcttctccgggaggggtaattaacgtttgtttgggggtgccaagaagagacattctcctccttatccccagttcatgtttatggccattgtggggcatcttttcccttttagcaaagggaaactttcttgtgctttgcttgatttctcaccgttcttttcttttccatttttgtaggagagaccccagggtggcctcccaacctccaaccagacactttcctctttgttatctcagtgtccctgtattagagaattgaagaatttcccatttttctaggaaaaagaaatgccgtttatttaaaaagacaggctaaattccttcttgttgagtagtccctcaccccttaagatccccagatgtatct

SEQ ID NO: 304644 - DNA, 1077 bp, Homo sapiens
agcaggggcgcggtggagcctggagtggagggcgagggtcccaccgtgacccgcctggagggcagcccagctctgggacgcgaaaccgcctacgacggtgccagttccaagagcctctgagttcctgccttttttcatctctgaatccccaccattggcctacattgggagtggggcgacctatggggaaagcaaggtcctgagactctgagcaacttccccaagatcacacagctaggaagtgatgaagctgagacaagaccagccagcacttacccaccacggtgtgatgctgacgttagaggacaaggacatgaagggattctcctgggccatagtcccagccttaacctccctaggctacctgattatactggtggtctccatctttcccttctgggtgcgactgacaaacgaggagtcccacgaagtctttttcagtggcctatttgagaactgcttcaatgccaaatgctggaagcctcgacccttatccatttacatcatcctcggccgggttttcctgctctctgcagttttcttggctttcgtcaccaccttcatcatgatgccctttgcatccgagttcttcccgaggacctggaagcaaaactttgtgttagcctgcatcagcttcttcacaggggcctgtgccttcctggctttggtgctgcatgccctggagatcaaggctctgaggatgaagctcggccccctgcagttctccgtgctgtggccttactacgtgctgggcttcggcatctttctgttcatagtggctggtaccatctgcctcattcaagaaatggtttgcccttgctggcacttgttgtccacttcccagagtatggaggaggaccacgggagcctgtacctggacaatctggagagtttgggaggagaaccgagctcagtacaaaaggagacacaggtgacagcagaaacagtcatctagcccaggacatggcttctttacccttcttgaaacccgtgggagtgtgcccagggggggggtgggggtcctcaccaaccagtagtgcgagatcgagggggattacgggagttttggaaatcaaa

SEQ ID NO: 304645 - DNA, 873 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaaaaaaaaaac

SEQ ID NO: 304646 - DNA, 1677 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggattagaagcccaggacccaggaaggagacacaggaaatttattcaaagtccccacgctgcagttccaagagcctctgagttcctgccttttttcatctctgaatccccaccattggcctacattgggagtggggcgacctgtgatgctgacgttagaggacaaggacatgaagggattctcctgggccatagtcccagccttaacctccctaggctacctgattatactggtggtctccatctttcccttctgggtgcgactgacaaacgaggagtcccacgaagtctttttcagtggcctatttgagaactgcttcaatgccaaatgctggaagcctcgacccttatccatttacatcatcctcggccgggttttcctgctctctgcagttttcttggctttcgtcaccaccttcatcatgatgccctttgcatccgagttcttcccgaggacctggaagcaaaactttgtgttagcctgcatcagcttcttcacaggggcctgtgccttcctggctttggtgctgcatgccctggagatcaaggctctgaggatgaagctcggccccctgcagttctccgtgctgtggccttactacgtgctgggcttcggcatctttctgttcatagtggctggaccatctgccctattgaagaaatggcttgccccttgctggaacttggtgagcccttcccagaccacggacgagggaccctcgcaccctgtctccgcactcagttggctagttcggcaggacaccgcttgtggcgcctctccgacagctttcgcaggctctcacatactaccgacgcccgtcatgttctcatcccctgccccatgatcccacactgtcctcgcttccacccccgacttcgcccccccctcctcgctacgaccccacccgaccctacccctct

SEQ ID NO: 304647 - DNA, 1183 bp, Homo sapiens
agcaggggcgcggtggagcctggagtggagggcgagggtcccaccgtgacccgcctggagggcagcccagctctgggacgcgaaaccgcctacgacggtgccagttccaagagcctctgagttcctgccttttttcatctctgaatccccaccattggcctacattgggagtggggcgacctatggggaaagcaaggtcctgagactctgagcaacttccccaagatcacacagctaggaagtgatgaagctgagacaagaccagccagcacttacccaccacggtgtgatgctgacgttagaggacaaggacatgaagggattctcctgggccatagtcccagccttaacctccctaggctacctgattatactggtggtctccatctttcccttctgggtgcgactgacaaacgaggagtcccacgaagtctttttcagtggcctatttgagaactgcttcaatgccaaatgctggaagcctcgacccttatccatttacatcatcctcggccgggttttcctgctctctgcagttttcttggctttcgtcaccaccttcatcatgatgccctttgcatccgagttcttcccgaggacctggaagcaaaactttgtgttagcctgcatcagcttcttcacaggggcctgtgccttcctggctttggtgctgcatgccctggagatcaaggctctgaggatgaagctcggccccctgcagttctccgtgctgtggccttactacgtgctgggcttcggcatctttctgttcatagtggctggtaccatctgcctcattcaagaaatggtttgcccttgctggcacttgttgtccactccccatactcacagtgattctatcttgcttgtatgtgaaatttgctaaaagtcctttcaactcttctgagcttcctaagtgacgtttttgcaggtattttcaataaaaagaagggctactttgttcatccatatctcaaaaaccaagtccgcagggcaggaggggagggaggaatattacaagataaccaagtgaaatgggattttgtgaaacagaaaccgtacagaatacagaatatactcgggggaatgacaactatttgggctggtggcacaggggtaaaagaatttaccaagacggttgtagataaagaaaggcagatttattaaaggaagtataaaagta

SEQ ID NO: 304648 - DNA, 1571 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggattagaagcccaggacccaggaaggagacacaggaaatttattcaaagtccccacgctgcagttccaagagcctctgagttcctgccttttttcatctctgaatccccaccattggcctacattgggagtggggcgacctgtgatgctgacgttagaggacaaggacatgaagggattctcctgggccatagtcccagccttaacctccctaggctacctgattatactggtggtctccatctttcccttctgggtgcgactgacaaacgaggagtcccacgaagtctttttcagtggcctatttgagaactgcttcaatgccaaatgctggaagcctcgacccttatccagggcctgtgccttcctggctttggtgctgcatgccctggagatcaaggctctgaggatgaagctcggccccctgcagttctccgtgctgtggccttactacgtgctgggcttcggcatctttctgttcatagtggctggtaccatctgcctcattcaagaaatggtttgcccttgctggcacttgttgtccacttcccagagtatggaggaggaccacgggagcctgtacctggacaatctggagagtttgggaggagaaccgagctcagtacaaaaggagacacaggtgacagcagaaacagtcatctagcccaggacatggcttctttacccttcttacagcctcgtcgagcgtacccaggctactggctagagagtctctcccgctctatgtcaggctgcgtgcccttgtagacctaccaacgtgtttaaggagatttccagcctccaaaaaccagga

SEQ ID NO: 304649 - DNA, 1826 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggattagaagcccaggacccaggaaggagacacaggaaatttattcaaagtccccacgctgcagttccaagagcctctgagttcctgccttttttcatctctgaatccccaccattggcctacattgggagtggggcgacctgtgatgctgacgttagaggacaaggacatgaagggattctcctgggccatagtcccagccttaacctccctaggctacctgattatactggtggtctccatctttcctgacaaacgaggagtcccacgaagtctttttcagtggcctatttgagaactgcttcaatgccaaatgctggaagcctcgacccttatccagggcctgtgccttcctggctttggtgctgcatgccctggagatcaaggctctgaggatgaagctcggccccctgcagttctccgtgctgtggccttactacgtgctgggcttcggcatgtaccatctgcctcattcaagaaatggtttgcccttgctggcacttgttgtccacttcccagagtatggaggagggacaatctggagagtttgggaggagaaccgagctcagtacaaaaggagacacaggtgacagcagaaacagtcatctagcccaggacatggcttctttacccttctatgtagctgtttgtagtcctccccaccctctctgccagtatctgtgcctttgaggagcttcttgcgtgtcagatcaactctccacctccccatactcacagtgattctatcttgcttgtatgtgaaatttgctaaaagtcctttcaactcttctgagcttcctaagtgacgtttttgcaggtattttcaataaaaagaagggctactttgttcatccatatctcaaaaaccaagtccgcagggcaggaggggagggaggaatattacaagataaccaagtgaaatgggattttgtgaaacagaaaccgtacagaatacagaatatactcgggggaatgacaactatttgggctggtggcacaggggtaaaagaatttaccaagacggttgtagataaagaaaggcagatttattaaaggaagtataaaagta

SEQ ID NO: 304650 - DNA, 663 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggtggtaagaactttgtgttcagtatggacagaatgaaggagggaatggttaggccgaacttatagcctttcttgcacccagcacacataaagtttgggccttacctcagagattcctgaactctttttgagcatg

SEQ ID NO: 304651 - DNA, 1001 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggatttccaatttccaagcctgatgggatctcccagctggaacaggatctacaggtctttgatctggaaactaagactagagaagtcttaagagatgactgctcaggtgagtaaggcagaatcagatagaattagtagggaagtaaagttcaattgttgagccaagttgtagctgctttggcactcagaatgaagagctctgtgtgtgtcctagcatggagagttccttccttttcccttcagttaggttgaccctttccatttgtttagtatccgtgcacatgtcgtactagaccccaatcaagttgcttatctaaaattctttcagctgtttccctattatttccttactctgctgaacatgtccgctgttttacctcactgctcctgtttatgcccttaacttctgctgttgagattttgtgcctgtttttcagagtaaataaacttttcttgtccttgtagatactaca

SEQ ID NO: 304652 - DNA, 732 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctggtctgtatgtcctcactggtccttttgggactttgccttggcctgcgttgctctcaggattccgggaaaaggccggtctagctggtctgagttagcgaagggcctgaccccaaaagtggagttttattcgccaagc

SEQ ID NO: 304653 - DNA, 3478 bp, Homo sapiens
cggccgctggggatctgagtgggctccgccccgcctcggacccgcccctcccggcctcccgccgcaatcttggcgggaaggcgccggccgctaagaagccgaaagatgtccaggtcgggcgcggcggctgagaaggcggactccagacagcgaccccagatgaaggtaaatgaatataaagaaaatcaaaacatcgcttatgtgtctctgagaccagcacagactacagttttaataaaaacagctaaggtctatcttgcccccttttcactcagtaattaccagctagaccagcttatgtgccccaaatccctatcagaaaagaattctaacaatgaagtggcgtgtaagaagactaaaataaagaaaacttgcagaaggattatacctccaaagatgaaaaacacatcttccaaggcagaatccacgctgcaaaattcatcctcagctgttcatactgaaagtaacaagctacaacccaagagaacggcagatgcgatgaatctcagtgttgatgtggaaagtagtcaggatggagacagtgatgaagataccacaccagccctggatttttcgggattgtcaccctacgaaaggaagagactgaagaacatatcagaaaacgcagacttttttgcttctcttcagttgtctgagtctgctgcaagactccgtgaaatgatagagaagagacagcctcctaaatccaaaagaaagaagcctaagagagaaaatgggattggatgtagaaggtcaatgcgattactaaaagttgatccttcgggagtttcattaccagcagctccaacaccgccgacattagtagcagatgaaactcctttgttacctcctgggcctttagaaatgacttctgaaaatcaagaagacaacaatgaacgatttaaaggatttctgcacacatgggcaggaatgagcaagccaagtagtaagaacactgagaagggattatctagcattaaaagctacaaagccaatttaaatggcatggtcattagtgaagataccgtttacaaagttaccacaggcccaatattctctatggctctccatccatcagaaactagaactttggtagcagttggggccaaatttgggcaagttggactttgtgatttgacccagcaacctaaagaagatggagtttatgtttttcatccccatagtcagccagttagctgtctttacttctcacccgccaatccggcccacatactgtcactgagctatgatggcacgttacgctgtggggatttttccagggctatttttgaagaggtgtatagaaatgaaagaagtagcttttcctccttcgacttcttggcagaagatgcctccactttaatagtaggacactgggatggaaatatgtcactggtggatagacggacacctggaacttcttatgagaaacttaccagttcttctatgggaaaaataagaactgttcatgtccacccagtgcatagacagtattttatcactgccggattgagggatactcatatttatgatgcaaggcgattgaattccaggagaagtcagcctttgatttctttgactgaacatacaaagagcattgcttccgcctatttttcacctcttactggtaacagagtggtgaccacatgtgctgattgtaatctgagaatttttgacagcagctgtatatcttctaagattccgctcctcaccaccatcaggcacaacactttcactgggcgatggctgaccaggttccaagccatgtgggatcctaaacaagaagactgtgtcatagttggcagcatggcccatccacgacgggtagaaatcttccatgagacaggaaagagggtgcattcgtttggtggagaataccttgtctctgtgtgttccatcaatgccatgcacccaactcggtatattttggctggaggtaattccagcgggaagatacatgtttttatgaatgaaaaaagctgctgagtttttggtttaggaacatcaatttgttcaaattgaccactgtctaaggagcctagtaatcggcgtgccttagtgtgtttatgtggtaatgtgttacatttagcaattataacattgttttattaataagactataagaagagtgtacttttagtaagggagaagtcttggagggttgcttctgcaggacggggagggaatttgaggggaggctgaggtgccgtcaggactttttttttttttttttttttgagatggagttttgctcttgttgcccaggctggagtgcaatagcgcgatcttggctcaccgcaacctccgcctcccaggttcaagcgattctcctgcctcagactcctaagtagctgggattacaggcacctgccaccacgcctggctatttttttgtatttttagtagagatggggtttcatcatgttggccaggctggtctcgagctcctgacctcaggtgatctgcccgcctcggcctccaaaagtgctggaattacaggcgtgagccaccatgcctggccatcagaacttgtaatcaagacagtatgttgagaaattctaacattataaattacaaagctttgactattaaagtttttgtgatctaatgatacagttttgattctatagtaatttgtggcttattttatagtttataatgaatacttatttctagactcatacactggaaggggacccggaaaggtaatgtaactcagtgattttaaaacttgatttttttaactgagaactttttttgccccctgcctgtaggttaagtcttacgtgaaatgccaagataattgctgagcagctttggttacccagggcggggtctgggtctgtctgtactttgcctttactctagatggctcctgagacacaggcaggactcccaagcaccgggttgggatctgccctggtcccggcattccagtataagattgcctcagacctgtgtttttcagactgggtttttgctcttcacatgaaatcaagttagatgacaatgactggtgttgaaaaaaatgaaaaggaaagaatttgtaaagaacagaaaatatatttgagtaagtattgtttggtaaaacttagttacatatgcatatatatttgttaggtatatatgtttatgtgtattctgatgtaaaatatatatatatatatattttattactatagtaccatgggtaatggataaagaagttaaagctactgcttagaatgaagaaggccccaggcttacctgtcccgatctttaaactgtccgaaggaaattcaatagcctgttaagtgaataccttcattcttacttgtatttggggaatttttgactactcccccgtctggatttgaaacgttccttctcagagtttggccatcacgcgcttgttgtggcgggaggccaacagcaacattacggggaccctcaaacaaaaaggcggggaagaaactggggaccaacgcacgatttacgg

SEQ ID NO: 304654 - DNA, 2693 bp, Homo sapiens
cggccgctggggatctgagtgggctccgccccgcctcggacccgcccctcccggcctcccgccgcaatcttggcgggaaggcgccggccgctaagaagccgaaagatgtccaggtcgggcgcggcggctgagaaggcggactccagacagcgaccccagatgaaggtaaatgaatataaagaaaatcaaaacatcgcttatgtgtctctgagaccagcacagactacagttttaataaaaacagctaaggtctatcttgcccccttttcactcagtaattaccagctagaccagcttatgtgccccaaatccctatcagaaaagaattctaacaatgaagtggcgtgtaagaagactaaaataaagaaaacttgcagaaggattatacctccaaagatgaaaaacacatcttccaaggcagaatccacgctgcaaaattcatcctcagctgttcatactgaaagtaacaagctacaacccaagagaacggcagatgcgatgaatctcagtgttgatgtggaaagtagtcaggatggagacagtgatgaagataccacaccagccctggatttttcgggattgtcaccctacgaaaggaagagactgaagaacatatcagaaaacgcagacttttttgcttctcttcagttgtctgagtctgctgcaagactccgtgaaatgatagagaagagacagcctcctaaatccaaaagaaagaagcctaagagagaaaatgggattggatgtagaaggtcaatgcgattactaaaagttgatccttcgggagtttcattaccagcagctccaacaccgccgacattagtagcagatgaaactcctttgttacctcctgggcctttagaaatgacttctgaaaatcaagaagacaacaatgaacgatttaaaggatttctgcacacatgggcaggaatgagcaagccaagtagtaagaacactgagaagggattatctagcattaaaagctacaaagccaatttaaatggcatggtcattagtgaagataccgtttacaaagttaccacaggcccaatattctctatggctctccatccatcagaaactagaactttggtagcagttggggccaaatttgggcaagttggactttgtgatttgacccagcaacctaaagaagatggagtttatgtttttcatccccatagtcagccagttagctgtctttacttctcacccgccaatccggcccacatactgtcactgagctatgatggcacgttacgctgtggggatttttccagggctatttttgaagaggtgtatagaaatgaaagaagtagcttttcctccttcgacttcttggcagaagatgcctccactttaatagtaggacactgggatggaaatatgtcactggtggatagacggacacctggaacttcttatgagaaacttaccagttcttctatgggaaaaataagaactgttcatgtccacccagtgcatagacagtattttatcactgccggattgagggatactcatatttatgatgcaaggcgattgaattccaggagaagtcagcctttgatttctttgactgaacatacaaagagcattgcttccgcctatttttcacctcttactggtaacagagtggtgaccacatgtgctgattgtaatctgagaatttttgacagcagctgtatatcttctaagattccgctcctcaccaccatcagccaccatgcctggccatcagaacttgtaatcaagacagtatgttgagaaattctaacattataaattacaaagctttgactattaaagtttttgtgatctaatgatacagttttgattctatagtaatttgtggcttattttatagtttataatgaatacttatttctagactcatacactggaaggggacccggaaaggtaatgtaactcagtgattttaaaacttgatttttttaactgagaactttttttgccccctgcctgtaggttaagtcttacgtgaaatgccaagataattgctgagcagctttggttacccagggcggggtctgggtctgtctgtactttgcctttactctagatggctcctgagacacaggcaggactcccaagcaccgggttgggatctgccctggtcccggcattccagtataagattgcctcagacctgtgtttttcagactgggtttttgctcttcacatgaaatcaagttagatgacaatgactggtgttgaaaaaaatgaaaaggaaagaatttgtaaagaacagaaaatatatttgagtaagtattgtttggtaaaacttagttacatatgcatatatatttgttaggtatatatgtttatgtgtattctgatgtaaaatatatatatatatatattttattactatagtaccatgggtaatggataaagaagttaaagctactgcttagaatgaagaaggccccaggcttacctgtcccgatctttaaactgtccgaaggaaattcaatagcctgttaagtgaataccttcattcttacttgtatttggggaatttttgactactcccccgtctggatttgaaacgttccttctcagagtttggccatcacgcgcttgttgtggcgggaggccaacagcaacattacggggaccctcaaacaaaaaggcggggaagaaactggggaccaacgcacgatttacgg

SEQ ID NO: 304655 - DNA, 3504 bp, Homo sapiens
cggccgctggggatctgagtgggctccgccccgcctcggacccgcccctcccggcctcccgccgcaatcttggcgggaaggcgccggccgctaagaagccgaaagatgtccaggtcgggcgcggcggctgagaaggcggactccagacagcgaccccagatgaaggtgagaaacggactggtgcttccaaggtaaatgaatataaagaaaatcaaaacatcgcttatgtgtctctgagaccagcacagactacagttttaataaaaacagctaaggtctatcttgcccccttttcactcagtaattaccagctagaccagcttatgtgccccaaatccctatcagaaaagaattctaacaatgaagtggcgtgtaagaagactaaaataaagaaaacttgcagaaggattatacctccaaagatgaaaaacacatcttccaaggcagaatccacgctgcaaaattcatcctcagctgttcatactgaaagtaacaagctacaacccaagagaacggcagatgcgatgaatctcagtgttgatgtggaaagtagtcaggatggagacagtgatgaagataccacaccagccctggatttttcgggattgtcaccctacgaaaggaagagactgaagaacatatcagaaaacgcagacttttttgcttctcttcagttgtctgagtctgctgcaagactccgtgaaatgatagagaagagacagcctcctaaatccaaaagaaagaagcctaagagagaaaatgggattggatgtagaaggtcaatgcgattactaaaagttgatccttcgggagtttcattaccagcagctccaacaccgccgacattagtagcagatgaaactcctttgttacctcctgggcctttagaaatgacttctgaaaatcaagaagacaacaatgaacgatttaaaggatttctgcacacatgggcaggaatgagcaagccaagtagtaagaacactgagaagggattatctagcattaaaagctacaaagccaatttaaatggcatggtcattagtgaagataccgtttacaaagttaccacaggcccaatattctctatggctctccatccatcagaaactagaactttggtagcagttggggccaaatttgggcaagttggactttgtgatttgacccagcaacctaaagaagatggagtttatgtttttcatccccatagtcagccagttagctgtctttacttctcacccgccaatccggcccacatactgtcactgagctatgatggcacgttacgctgtggggatttttccagggctatttttgaagaggtgtatagaaatgaaagaagtagcttttcctccttcgacttcttggcagaagatgcctccactttaatagtaggacactgggatggaaatatgtcactggtggatagacggacacctggaacttcttatgagaaacttaccagttcttctatgggaaaaataagaactgttcatgtccacccagtgcatagacagtattttatcactgccggattgagggatactcatatttatgatgcaaggcgattgaattccaggagaagtcagcctttgatttctttgactgaacatacaaagagcattgcttccgcctatttttcacctcttactggtaacagagtggtgaccacatgtgctgattgtaatctgagaatttttgacagcagctgtatatcttctaagattccgctcctcaccaccatcaggcacaacactttcactgggcgatggctgaccaggttccaagccatgtgggatcctaaacaagaagactgtgtcatagttggcagcatggcccatccacgacgggtagaaatcttccatgagacaggaaagagggtgcattcgtttggtggagaataccttgtctctgtgtgttccatcaatgccatgcacccaactcggtatattttggctggaggtaattccagcgggaagatacatgtttttatgaatgaaaaaagctgctgagtttttggtttaggaacatcaatttgttcaaattgaccactgtctaaggagcctagtaatcggcgtgccttagtgtgtttatgtggtaatgtgttacatttagcaattataacattgttttattaataagactataagaagagtgtacttttagtaagggagaagtcttggagggttgcttctgcaggacggggagggaatttgaggggaggctgaggtgccgtcaggactttttttttttttttttttttgagatggagttttgctcttgttgcccaggctggagtgcaatagcgcgatcttggctcaccgcaacctccgcctcccaggttcaagcgattctcctgcctcagactcctaagtagctgggattacaggcacctgccaccacgcctggctatttttttgtatttttagtagagatggggtttcatcatgttggccaggctggtctcgagctcctgacctcaggtgatctgcccgcctcggcctccaaaagtgctggaattacaggcgtgagccaccatgcctggccatcagaacttgtaatcaagacagtatgttgagaaattctaacattataaattacaaagctttgactattaaagtttttgtgatctaatgatacagttttgattctatagtaatttgtggcttattttatagtttataatgaatacttatttctagactcatacactggaaggggacccggaaaggtaatgtaactcagtgattttaaaacttgatttttttaactgagaactttttttgccccctgcctgtaggttaagtcttacgtgaaatgccaagataattgctgagcagctttggttacccagggcggggtctgggtctgtctgtactttgcctttactctagatggctcctgagacacaggcaggactcccaagcaccgggttgggatctgccctggtcccggcattccagtataagattgcctcagacctgtgtttttcagactgggtttttgctcttcacatgaaatcaagttagatgacaatgactggtgttgaaaaaaatgaaaaggaaagaatttgtaaagaacagaaaatatatttgagtaagtattgtttggtaaaacttagttacatatgcatatatatttgttaggtatatatgtttatgtgtattctgatgtaaaatatatatatatatatattttattactatagtaccatgggtaatggataaagaagttaaagctactgcttagaatgaagaaggccccaggcttacctgtcccgatctttaaactgtccgaaggaaattcaatagcctgttaagtgaataccttcattcttacttgtatttggggaatttttgactactcccccgtctggatttgaaacgttccttctcagagtttggccatcacgcgcttgttgtggcgggaggccaacagcaacattacggggaccctcaaacaaaaaggcggggaagaaactggggaccaacgcacgatttacgg

SEQ ID NO: 304656 - DNA, 3368 bp, Homo sapiens
cggccgctggggatctgagtgggctccgccccgcctcggacccgcccctcccggcctcccgccgcaatcttggcgggaaggcgccggccgctaagaagccgaaagatgtccaggtcgggcgcggcggctgagaaggcggactccagacagcgaccccagatgaagtaattaccagctagaccagcttatgtgccccaaatccctatcagaaaagaattctaacaatgaagtggcgtgtaagaagactaaaataaagaaaacttgcagaaggattatacctccaaagatgaaaaacacatcttccaaggcagaatccacgctgcaaaattcatcctcagctgttcatactgaaagtaacaagctacaacccaagagaacggcagatgcgatgaatctcagtgttgatgtggaaagtagtcaggatggagacagtgatgaagataccacaccagccctggatttttcgggattgtcaccctacgaaaggaagagactgaagaacatatcagaaaacgcagacttttttgcttctcttcagttgtctgagtctgctgcaagactccgtgaaatgatagagaagagacagcctcctaaatccaaaagaaagaagcctaagagagaaaatgggattggatgtagaaggtcaatgcgattactaaaagttgatccttcgggagtttcattaccagcagctccaacaccgccgacattagtagcagatgaaactcctttgttacctcctgggcctttagaaatgacttctgaaaatcaagaagacaacaatgaacgatttaaaggatttctgcacacatgggcaggaatgagcaagccaagtagtaagaacactgagaagggattatctagcattaaaagctacaaagccaatttaaatggcatggtcattagtgaagataccgtttacaaagttaccacaggcccaatattctctatggctctccatccatcagaaactagaactttggtagcagttggggccaaatttgggcaagttggactttgtgatttgacccagcaacctaaagaagatggagtttatgtttttcatccccatagtcagccagttagctgtctttacttctcacccgccaatccggcccacatactgtcactgagctatgatggcacgttacgctgtggggatttttccagggctatttttgaagaggtgtatagaaatgaaagaagtagcttttcctccttcgacttcttggcagaagatgcctccactttaatagtaggacactgggatggaaatatgtcactggtggatagacggacacctggaacttcttatgagaaacttaccagttcttctatgggaaaaataagaactgttcatgtccacccagtgcatagacagtattttatcactgccggattgagggatactcatatttatgatgcaaggcgattgaattccaggagaagtcagcctttgatttctttgactgaacatacaaagagcattgcttccgcctatttttcacctcttactggtaacagagtggtgaccacatgtgctgattgtaatctgagaatttttgacagcagctgtatatcttctaagattccgctcctcaccaccatcaggcacaacactttcactgggcgatggctgaccaggttccaagccatgtgggatcctaaacaagaagactgtgtcatagttggcagcatggcccatccacgacgggtagaaatcttccatgagacaggaaagagggtgcattcgtttggtggagaataccttgtctctgtgtgttccatcaatgccatgcacccaactcggtatattttggctggaggtaattccagcgggaagatacatgtttttatgaatgaaaaaagctgctgagtttttggtttaggaacatcaatttgttcaaattgaccactgtctaaggagcctagtaatcggcgtgccttagtgtgtttatgtggtaatgtgttacatttagcaattataacattgttttattaataagactataagaagagtgtacttttagtaagggagaagtcttggagggttgcttctgcaggacggggagggaatttgaggggaggctgaggtgccgtcaggactttttttttttttttttttttgagatggagttttgctcttgttgcccaggctggagtgcaatagcgcgatcttggctcaccgcaacctccgcctcccaggttcaagcgattctcctgcctcagactcctaagtagctgggattacaggcacctgccaccacgcctggctatttttttgtatttttagtagagatggggtttcatcatgttggccaggctggtctcgagctcctgacctcaggtgatctgcccgcctcggcctccaaaagtgctggaattacaggcgtgagccaccatgcctggccatcagaacttgtaatcaagacagtatgttgagaaattctaacattataaattacaaagctttgactattaaagtttttgtgatctaatgatacagttttgattctatagtaatttgtggcttattttatagtttataatgaatacttatttctagactcatacactggaaggggacccggaaaggtaatgtaactcagtgattttaaaacttgatttttttaactgagaactttttttgccccctgcctgtaggttaagtcttacgtgaaatgccaagataattgctgagcagctttggttacccagggcggggtctgggtctgtctgtactttgcctttactctagatggctcctgagacacaggcaggactcccaagcaccgggttgggatctgccctggtcccggcattccagtataagattgcctcagacctgtgtttttcagactgggtttttgctcttcacatgaaatcaagttagatgacaatgactggtgttgaaaaaaatgaaaaggaaagaatttgtaaagaacagaaaatatatttgagtaagtattgtttggtaaaacttagttacatatgcatatatatttgttaggtatatatgtttatgtgtattctgatgtaaaatatatatatatatatattttattactatagtaccatgggtaatggataaagaagttaaagctactgcttagaatgaagaaggccccaggcttacctgtcccgatctttaaactgtccgaaggaaattcaatagcctgttaagtgaataccttcattcttacttgtatttggggaatttttgactactcccccgtctggatttgaaacgttccttctcagagtttggccatcacgcgcttgttgtggcgggaggccaacagcaacattacggggaccctcaaacaaaaaggcggggaagaaactggggaccaacgcacgatttacgg

SEQ ID NO: 304657 - DNA, 1796 bp, Homo sapiens
cggccgctggggatctgagtgggctccgccccgcctcggacccgcccctcccggcctcccgccgcaatcttggcgggaaggcgccggccgctaagaagccgaaagatgtccaggtcgggcgcggcggctgagaaggcggactccagacagcgaccccagatgaaggtaaatgaatataaagaaaatcaaaacatcgcttatgtgtctctgagaccagcacagactacagttttaataaaaacagctaaggtctatcttgcccccttttcactcagtaattaccagctagaccagcttatgtgccccaaatccctatcagaaaagaattctaacaatgaagtggcgtgtaagaagactaaaataaagaaaacttgcagaaggattatacctccaaagatgaaaaacacatcttccaaggcagaatccacgctgcaaaattcatcctcagctgttcatactgaaagtaacaagctacaacccaagagaacggcagatgcgatgaatctcagtgttgatgtggaaagtagtcaggatggagacagtgatgaagataccacaccagccctggatttttcgggattgtcaccctacgaaaggaagagactgaagaacatatcagaaaacgcagacttttttgcttctcttcagttgtctgagtctgctgcaagactccgtgaaatgatagagaagagacagcctcctaaatccaaaagaaagaagcctaagagagaaaatgggattggatgtagaaggtcaatgcgattactaaaagttgatccttcgggagtttcattaccagcagctccaacaccgccgacattagtagcagatgaaactcctttgttacctcctgggcctttagaaatgacttctgaaaatcaagaagacaacaatgaacgatttaaaggatttctgcacacatgggcaggaatgagcaagccaagtagtaagaacactgagaagggattatctagcattaaaagctacaaagccaatttaaatggcatggtcattagtgaagataccgtttacaaagttaccacaggcccaatattctctatggctctccatccatcagaaactagaactttggtagcagttggggccaaatttgggcaagttggactttgtgatttgacccagcaacctaaagaagatggagtttatgtttttcatccccatagtcagccagttagctgtctttacttctcacccgccaatccggcccacatactgtcactgagctatgatggcacgttacgctgtggggatttttccagggctatttttgaagaggtgtatagaaatgaaagaagtagcttttcctccttcgacttcttggcagaagatgcctccactttaatagtaggacactgggatggaaatatgtcactggtggatagacggacacctggaacttcttatgagaaacttaccagttcttctatgggaaaaataagaactgttcatgtccacccagtgcatagacagtattttatcactgccggattgagggatactcatatttatgatgcaaggcgattgaattccaggagaagtcagcctttgatttctttgactgaacatacaaagagcattgcttccgcctatttttcacctcttactggtaacagagtggtgaccacatgtgctgattgtaatctgagaatttttgacagcagctgtatatcttctaagattccgctcctcaccaccatcagcaggtaggcttctatatgccaaataatgtagatgtggattactatgaactatttgttgcagtgcatacattagac

SEQ ID NO: 304658 - DNA, 1364 bp, Homo sapiens
  misc_feature (1319)..(1319): n is a, c, g, or t
  misc_feature (1338)..(1338): n is a, c, g, or t
  misc_feature (1362)..(1362): n is a, c, g, or t
cggccgctggggatctgagtgggctccgccccgcctcggacccgcccctcccggcctcccgccgcaatcttggcgggaaggcgccggccgctaagaagccgaaagatgtccaggtcgggcgcggcggctgagaaggcggactccagacagcgaccccagatgaaggtaaatgaatataaagaaaatcaaaacatcgcttatgtgtctctgagaccagcacagactacagttttaataaaaacagctaaggtctatcttgcccccttttcactcagtaattaccagctagaccagcttatgtgccccaaatccctatcagaaaagaattctaacaatgaagtggcgtgtaagaagactaaaataaagaaaacttgcagaaggattatacctccaaagatgaaaaacacatcttccaaggcagaatccacgctgcaaaattcatcctcagctgttcatactgaaagtaacaagctacaacccaagagaacggcagatgcgatgaatctcagtgttgatgtggaaagtagtcaggatggagacagtgatgaagataccacaccagccctggatttttcgggattgtcaccctacgaaaggaagagactgaagaacatatcagaaaacgcagacttttttgcttctcttcagttgtctgagtctgctgcaagactccgtgaaatgatagagaagagacagcctcctaaatccaaaagaaagaagcctaagagagaaaatgggattggatgtagaaggtcaatgcgattactaaaagttgatccttcgggagtttcattaccagcagctccaacaccgccgacattagtagcagatgaaactcctttgttacctcctgggcctttagaaatgacttctgaaaatcaagaagacaacaatgaacgatttaaaggatttctgcacacatgggcaggaatgagcaagccaagtagtaagaacactgagaagggattatctagcattaaaagctacaaagccaatttaaatggcatggtcattagtgaagataccgtttacaaagttaccacaggcccaatattctctatggctctccatccatcagaaactagaactttggtagcagttggggccaaatttgggcaagttggactttgtgatttggtaagttattaaatttcttgaatatattatagtttgactaaagcaaataggctggaagagaataggctagagccatgtgtttataaatgttgcgtgagactttctcgttttccaccttgggccatcttcttccttcgtcgtctctcctctttaaatttcttttctattccatcatctgcccntttattcacttttaggccncttttttttaatttttaaaatttnaa

SEQ ID NO: 304659 - DNA, 2136 bp, Homo sapiens
gcggatactgcgatactcagatacagacttgagccaccgtactggctgagagttctgtcttaaatgttcttcagtatagcaagtatgtgagtgtctaacttatgtttagccctgttgtagaggttcattacatgtactatggcaacattgatcattgtttctcccattacagggatactcatatttatgatgcaaggcgattgaattccaggagaagtcagcctttgatttctttgactgaacatacaaagagcattgcttccgcctatttttcacctcttactggtaacagagtggtgaccacatgtgctgattgtaatctgagaatttttgacagcagctgtatatcttctaagattccgctcctcaccaccatcaggcacaacactttcactgggcgatggctgaccaggttccaagccatgtgggatcctaaacaagaagactgtgtcatagttggcagcatggcccatccacgacgggtagaaatcttccatgagacaggaaagagggtgcattcgtttggtggagaataccttgtctctgtgtgttccatcaatgccatgcacccaactcggtatattttggctggaggtaattccagcgggaagatacatgtttttatgaatgaaaaaagctgctgagtttttggtttaggaacatcaatttgttcaaattgaccactgtctaaggagcctagtaatcggcgtgccttagtgtgtttatgtggtaatgtgttacatttagcaattataacattgttttattaataagactataagaagagtgtacttttagtaagggagaagtcttggagggttgcttctgcaggacggggagggaatttgaggggaggctgaggtgccgtcaggactttttttttttttttttttttgagatggagttttgctcttgttgcccaggctggagtgcaatagcgcgatcttggctcaccgcaacctccgcctcccaggttcaagcgattctcctgcctcagactcctaagtagctgggattacaggcacctgccaccacgcctggctatttttttgtatttttagtagagatggggtttcatcatgttggccaggctggtctcgagctcctgacctcaggtgatctgcccgcctcggcctccaaaagtgctggaattacaggcgtgagccaccatgcctggccatcagaacttgtaatcaagacagtatgttgagaaattctaacattataaattacaaagctttgactattaaagtttttgtgatctaatgatacagttttgattctatagtaatttgtggcttattttatagtttataatgaatacttatttctagactcatacactggaaggggacccggaaaggtaatgtaactcagtgattttaaaacttgatttttttaactgagaactttttttgccccctgcctgtaggttaagtcttacgtgaaatgccaagataattgctgagcagctttggttacccagggcggggtctgggtctgtctgtactttgcctttactctagatggctcctgagacacaggcaggactcccaagcaccgggttgggatctgccctggtcccggcattccagtataagattgcctcagacctgtgtttttcagactgggtttttgctcttcacatgaaatcaagttagatgacaatgactggtgttgaaaaaaatgaaaaggaaagaatttgtaaagaacagaaaatatatttgagtaagtattgtttggtaaaacttagttacatatgcatatatatttgttaggtatatatgtttatgtgtattctgatgtaaaatatatatatatatatattttattactatagtaccatgggtaatggataaagaagttaaagctactgcttagaatgaagaaggccccaggcttacctgtcccgatctttaaactgtccgaaggaaattcaatagcctgttaagtgaataccttcattcttacttgtatttggggaatttttgactactcccccgtctggatttgaaacgttccttctcagagtttggccatcacgcgcttgttgtggcgggaggccaacagcaacattacggggaccctcaaacaaaaaggcggggaagaaactggggaccaacgcacgatttacgg

SEQ ID NO: 304660 - DNA, 2046 bp, Homo sapiens
gcggatactgcgatactcagatacagacttgagccaccgtactggctgagagttctgtcttaaatgttcttcagtatagcaaggatactcatatttatgatgcaaggcgattgaattccaggagaagtcagcctttgatttctttgactgaacatacaaagagcattgcttccgcctatttttcacctcttactggtaacagagtggtgaccacatgtgctgattgtaatctgagaatttttgacagcagctgtatatcttctaagattccgctcctcaccaccatcaggcacaacactttcactgggcgatggctgaccaggttccaagccatgtgggatcctaaacaagaagactgtgtcatagttggcagcatggcccatccacgacgggtagaaatcttccatgagacaggaaagagggtgcattcgtttggtggagaataccttgtctctgtgtgttccatcaatgccatgcacccaactcggtatattttggctggaggtaattccagcgggaagatacatgtttttatgaatgaaaaaagctgctgagtttttggtttaggaacatcaatttgttcaaattgaccactgtctaaggagcctagtaatcggcgtgccttagtgtgtttatgtggtaatgtgttacatttagcaattataacattgttttattaataagactataagaagagtgtacttttagtaagggagaagtcttggagggttgcttctgcaggacggggagggaatttgaggggaggctgaggtgccgtcaggactttttttttttttttttttttgagatggagttttgctcttgttgcccaggctggagtgcaatagcgcgatcttggctcaccgcaacctccgcctcccaggttcaagcgattctcctgcctcagactcctaagtagctgggattacaggcacctgccaccacgcctggctatttttttgtatttttagtagagatggggtttcatcatgttggccaggctggtctcgagctcctgacctcaggtgatctgcccgcctcggcctccaaaagtgctggaattacaggcgtgagccaccatgcctggccatcagaacttgtaatcaagacagtatgttgagaaattctaacattataaattacaaagctttgactattaaagtttttgtgatctaatgatacagttttgattctatagtaatttgtggcttattttatagtttataatgaatacttatttctagactcatacactggaaggggacccggaaaggtaatgtaactcagtgattttaaaacttgatttttttaactgagaactttttttgccccctgcctgtaggttaagtcttacgtgaaatgccaagataattgctgagcagctttggttacccagggcggggtctgggtctgtctgtactttgcctttactctagatggctcctgagacacaggcaggactcccaagcaccgggttgggatctgccctggtcccggcattccagtataagattgcctcagacctgtgtttttcagactgggtttttgctcttcacatgaaatcaagttagatgacaatgactggtgttgaaaaaaatgaaaaggaaagaatttgtaaagaacagaaaatatatttgagtaagtattgtttggtaaaacttagttacatatgcatatatatttgttaggtatatatgtttatgtgtattctgatgtaaaatatatatatatatatattttattactatagtaccatgggtaatggataaagaagttaaagctactgcttagaatgaagaaggccccaggcttacctgtcccgatctttaaactgtccgaaggaaattcaatagcctgttaagtgaataccttcattcttacttgtatttggggaatttttgactactcccccgtctggatttgaaacgttccttctcagagtttggccatcacgcgcttgttgtggcgggaggccaacagcaacattacggggaccctcaaacaaaaaggcggggaagaaactggggaccaacgcacgatttacgg

SEQ ID NO: 304661 - DNA, 454 bp, Homo sapiens
gcggatactgcgatactcagatacagacttgagccaccgtactggctgagagttctgtcttaaatgttcttcagtatagcaagtatgtgagtgtctaacttatgtttagccctgttgtagaggttcattacatgtactatggcaacattgatcattgtttctcccattacagggatactcatatttatgatgcaaggcgattgaattccaggagaagtcagcctttgatttctttgactgaacatacaaagagcattgcttccgcctatttttcacctcttactggtaacagagtggtgaccacatgtgctgattgtaatctgagaatttttgacagcagctgtatatcttctaagattccgctcctcaccaccatcagcaggtaggcttctatatgccaaataatgtagatgtggattactatgaactatttgttgcagtgcatacattagac

SEQ ID NO: 304662 - DNA, 579 bp, Homo sapiens
ggatctttagttcctgaatagaccttagtttagtgtgggtatagtagcagatgcttaatattttaaaaggtaagatacgtagttataacatttttacatgatttttatactttacagtctgctgcaagactccgtgaaatgatagagaagagacagcctcctaaatccaaaaggtaaaatatctagtttgcaatgcctgaaccatgatacattgctcaactgttttataatttgaaaaaaatggtttggtgtggtaagcttaacagatcataaagtgctatttaatctcagtccctctaggatctctgagggaatgctaccctttaataactttacaattctcatcttcatcaaaggaatatggagcaaataaaatggagagctgaattttgtttatatttattgttgctactaatgaagggaaatctttatttccactaaattactgtcacttagaaaactattaaagattcttctacttacttttaatttttctggctatctttttgcgtctcaatttgtttttgctttcttagtcctagaataaaggaaaggaattaacatttattgaatatctct

SEQ ID NO: 304663 - DNA, 1966 bp, Homo sapiens
  misc_feature (1962)..(1963): n is a, c, g, or t
  misc_feature (1965)..(1965): n is a, c, g, or t
ctattttgggctcttgctgacctgggccaaagtcaggtccagtcaagagggcccaaagtggctccccccatccccagaggccggctctggtttctgctatataaacagaggaggacacgccggcttggaggcagcaccacatccagagctcgctcagctgctgcccagcctcggctgtgaggataggctggctgggcagcacgtctctccccacagggctccctgagaccaccaggaagagcccccaaccaatcttgggattctcccttcgtgcggttgtctgggacctttttccagggtcaaagcagatcgtgaggaggaagctgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaaggtaccgcgcagccccaggtggggccttttgttggaaatggagagaggctggcctcatcccattgggacctgtggtctccccctgggttctcctcctagctaagtcctgtcctgcagggtgggatcagccctgccaggtgggccgccttcctggagacccgtagatgccagggctggaagctttcatttgccgggacactcgggcccatgggattgcacagagctggagggaggggtgagataggggcagataggagctgcaggggtgcctggcgagcctctggttttcctctgctcctctgcctgtcctctcccaactcaaggttctagtgggaaggggtgcccccaggctctcatgttcctggcgtgagatgaaaggatccctgcggagggtttggttcttgagggctgggggtggacttgggaacaggctgtgtgtttgtcccagcgatggtgcctgcttagcttcccgtccccaccccccagccccttggccctctcctgtctgccctagggagaaggcaggtggacaagggcccatgaaaaaatacaggtgtctagactgccagggagaccctggcccccagtagtgtgtcctggggacttcctcagagcgagaaacctcccccaatgtcttcaagacttttctctccccccgcccaaccccgtctctccctcccttgccacccaaatgttagaaaaatagctgtgaacagagagcgcttttgtctgcaatggcagcaggatctggacggtccnntnc

SEQ ID NO: 304664 - DNA, 5496 bp, Homo sapiens
gagctttggcgctgctgggatccgtacgattctaactgggattggatttccaaaaggccctccttcctcccagcctgtcagctccctcccagtgtcccggttgttttcttaacactttagaggctgtggctgagttggcaggggttccccaccctgaactttctgtctgaggtgcgttaggaagcctccggatcattgaaggaagtgactggcttggtggctgacctgtggagggctgcttgctgtgtattgaataaaggaggcttcttggggtcggggcagggtctctgtaagcacagggagaattgatttcgctggggcttggatcacgtgtgtgtgtgtgtgtgtgtgtgtgtgtgtgtgagagagagagagagagagagagaaagagagacagaggtggaaacccttgtccttggggatcctggatagaagttgccagtgttggagtcttggggcggtgctgcctagaggatacctcccaaccattccagctccagatgctgatcatccctatgccccctcccccagtagtctctgttggatcttacaggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatgtaggtccatatcttgtgttgttaagaacctgcatgaagggggagggactgatgggggttgatccggatgtgggacgtccaggtggagaaacaggatttgaataaggcaggaacaagcgcccagttctgcccaactgctgtctttcctccttcacccccagcccatccctggccaggctgtcctagtgcaggcagatgtggccaccctcacctctcgcagggtgctgcatgcctgtggactggtgccactgggtgtgtggggcctgagctacaagggtctctgttgtcttggttgtcaggctaggggtggaggtgccctgttcagggcctgtggagttagaaggaaggctaggaccagagaggacttcctgggctcttggccaggaggtggtgacagcctttgcccccatcactgcaccccttgattatggtactctgttcctgcttgatttcttctccagcttccctcattgactggtgaggccagagttacgcagaccccaggtgtgtaggttgggagggagactgtcctggagcctcctctgcattattttttgaccattctgtgaatgtaaggatctgcctgaatgatgctatctctgttcaggctctcttcaggctcctcgggactggggctgtgtaaccccctttgcctgagcctctggattcttcagggcacagaccctgctttagtggagggacccaggcaggggcagaatgtcttccacccacccaccagcaggcttctccttaagtcttctgctggactctcagagttctcttattaagataactgggggcagcagaacattctttttaggtactgttgtccattctcctgagagtccagggggctgtggtctccttcctccccccttgccctgtccccagcaaatggcctttaaaggtctggagccaggttaccgatgaggaggcctaggttcccttcctctttgcttctgggagcatctcgagcagtgcagagtggcttcccagccccagatggcaggattggggtgggtttgggatctgctgcctttgctcagtgtgcagggttggggtggaaatgggggacaggctagggcctctgcattaggctgccttcttaggcaggtgggctttcacttccagctcctcttccattttcacgatgtccttcttcctaggcactgcgaggggaggagaaaaggggctttgcagaggcctgggagtattcccaggaagtgcctggttggcgaaacaaccagggagctgctcctgggagctgggctgaggctttgctgggctgcctctcccactcacccttctcccggcccccaccatgccttccccatgggggaggggcagggggctggaggaacacagcttccccctgttctagcagagaaatgctggctgtatgcctcccctagggttcccaggctgactagggtgtggctggccttctgatggagcccactcatgctgggccgctgcccaggggctttgtggcacctaggtcgagatggtactcaggccaggggtcaggattcctgggtgctctggtcccggtgcctctgtctcatctttaggctgggattcctgccaccttgctgctcgggggcccaaatactttgagacaaggctataggcttgtcccactgactctcctttccctccctggggtctcctctctctccagagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304665 - DNA, 2665 bp, Homo sapiens
cggggagtcccagtggcggaggctacgaaacttgggggagtgcacagaagaacttcgggagcgcacgcgggaccaggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304666 - DNA, 3815 bp, Homo sapiens
gagctttggcgctgctgggatccgtacgattctaactgggattggatttccaaaaggccctccttcctcccagcctgtcagctccctcccagtgtcccggttgttttcttaacactttagaggctgtggctgagttggcaggggttccccaccctgaactttctgtctgaggtgcgttaggaagcctccggatcattgaaggaagtgactggcttggtggctgacctgtggagggctgcttgctgtgtattgaataaaggaggcttcttggggtcggggcagggtctctgtaagcacagggagaattgatttcgctggggcttggatcacgtgtgtgtgtgtgtgtgtgtgtgtgtgtgtgtgagagagagagagagagagagagaaagagagacagaggtggaaacccttgtccttggggatcctggatagaagttgccagtgttggagtcttggggcggtgctgcctagaggatacctcccaaccattccagctccagatgctgatcatccctatgccccctcccccagtagtctctgttggatcttacaggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304667 - DNA, 3438 bp, Homo sapiens
ctattttgggctcttgctgacctgggccaaagtcaggtccagtcaagagggcccaaagtggctccccccatccccagaggccggctctggtttctgctatataaacagaggaggacacgccggcttggaggcagcaccacatccagagctcgctcagctgctgcccagcctcggctgtgaggataggctggctgggcagcacgtctctccccacagggctccctgagaccaccaggaagagcccccaaccaatcttgggattctcccttcgtgcggttgtctgggacctttttccagggtcaaagcagatcgtgaggaggaagctgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304668 - DNA, 3296 bp, Homo sapiens
gggccggctggtgcgcgaccccggaaagcgggggtggagaggcgagcggagcccgcggggccaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304669 - DNA, 3188 bp, Homo sapiens
cggggagtcccagtggcggaggctacgaaacttgggggagtgcacagaagaacttcgggagcgcacgcgggaccaggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304670 - DNA, 2276 bp, Homo sapiens
cccacactctgacagcttgttccgtgttgcccccccacccagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304671 - DNA, 1855 bp, Homo sapiens
gttcgacagatcaaagagaggatccccctctcggctgaccagatgggaaaatgcaccccctcaggcaggtggccaattagaaaaattgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304672 - DNA, 1231 bp, Homo sapiens
tagagtatcccccgctggcccgttgtgtggctctttgtgtggcatcgctgtgtggcacttcgaggacaactatacattcggtcaaccgggaccccaacgcgccacgtgcaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304673 - DNA, 3072 bp, Homo sapiens
cggggagtcccagtggcggaggctacgaaacttgggggagtgcacagaagaacttcgggagcgcacgcgggaccaggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggatatgagagtgcgcatgtgcacacgtgttcccaggcaggggtcagaagggcagcgtgtccatgaagatc

SEQ ID NO: 304674 - DNA, 1112 bp, Homo sapiens
ctgtctcagcctcctaaagtgctgggattacaggtgtgagccaccacgcctagcccttcactgtgacttctgacagtgcagatcagattggttgtgcctgttttggactttatgtaaatgtagttctgcaggatggaatctggtgttgaatgcagaggttttcagatttctctgttttttaaaggaaagaatccaccctcgttcattttttcacttaaattgcacaggggacccaacgatatagaacacaatcagaggtactctgggctgagggagtgctgagttctgaggctgggtttctcagaacagtctagattttaaaaacccaatgatctagccagaaaacgtaggttaggattttatttcccgtttgtgaccctgggcaagtcattagcctcctgggcctcgggttctcacttggagtatgaggataatgagggttactgcttctcagacttgtgacgatgcttactaatggccaacatgtgaatgcgcttttgtgaagtgccagcagagcatgaggggtggtcaggggcagcagttttaggggcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304675 - DNA, 2376 bp, Homo sapiens
cggggagtcccagtggcggaggctacgaaacttgggggagtgcacagaagaacttcgggagcgcacgcgggaccaggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctctactttccgcgccgtgctgcactccgtagaggtgtgtgtgagaacatatgtgtcctagcaagggtgcacccccaggcatagcagccaagcccagttgtgttggcacctctaa

SEQ ID NO: 304676 - DNA, 1771 bp, Homo sapiens
  misc_feature (1767)..(1768): n is a, c, g, or t
  misc_feature (1770)..(1770): n is a, c, g, or t
cggggagtcccagtggcggaggctacgaaacttgggggagtgcacagaagaacttcgggagcgcacgcgggaccaggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaaggtaccgcgcagccccaggtggggccttttgttggaaatggagagaggctggcctcatcccattgggacctgtggtctccccctgggttctcctcctagctaagtcctgtcctgcagggtgggatcagccctgccaggtgggccgccttcctggagacccgtagatgccagggctggaagctttcatttgccgggacactcgggcccatgggattgcacagagctggagggaggggtgagataggggcagataggagctgcaggggtgcctggcgagcctctggttttcctctgctcctctgcctgtcctctcccaactcaaggttctagtgggaaggggtgcccccaggctctcatgttcctggcgtgagatgaaaggatccctgcggagggtttggttcttgagggctgggggtggacttgggaacaggctgtgtgtttgtcccagcgatggtgcctgcttagcttcccgtccccaccccccagccccttggccctctcctgtctgccctagggagaaggcaggtggacaagggcccatgaaaaaatacaggtgtctagactgccagggagaccctggcccccagtagtgtgtcctggggacttcctcagagcgagaaacctcccccaatgtcttcaagacttttctctccccccgcccaaccccgtctctccctcccttgccacccaaatgttagaaaaatagctgtgaacagagagcgcttttgtctgcaatggcagcaggatctggacggtccnntnc

SEQ ID NO: 304677 - DNA, 2718 bp, Homo sapiens
gagctttggcgctgctgggatccgtacgattctaactgggattggatttccaaaaggccctccttcctcccagcctgtcagctccctcccagtgtcccggttgttttcttaacactttagaggctgtggctgagttggcaggggttccccaccctgaactttctgtctgaggtgcgttaggaagcctccggatcattgaaggaagtgactggcttggtggctgacctgtggagggctgcttgctgtgtattgaataaaggaggcttcttggggtcggggcagggtctctgtaagcacagggagaattgatttcgctggggcttggatcacgtgtgtgtgtgtgtgtgtgtgtgtgtgtgtgtgagagagagagagagagagagagaaagagagacagaggtggaaacccttgtccttggggatcctggatagaagttgccagtgttggagtcttggggcggtgctgcctagaggatacctcccaaccattccagctccagatgctgatcatccctatgccccctcccccagtagtctctgttggatcttacaggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatgtaggtccatatcttgtgttgttaagaacctgcatgaagggggagggactgatgggggttgatccggatgtgggacgtccaggtggagaaacaggatttgaataaggcaggaacaagcgcccagttctgcccaactgctgtctttcctccttcacccccagcccatccctggccaggctgtcctagtgcaggcagatgtggccaccctcacctctcgcagggtgctgcatgcctgtggactggtgccactgggtgtgtggggcctgagctacaagggtctctgttgtcttggttgtcaggctaggggtggaggtgccctgttcagggcctgtggagttagaaggaaggctaggaccagagaggacttcctgggctcttggccaggaggtggtgacagcctttgcccccatcactgcaccccttgattatggtactctgttcctgcttgatttcttctccagcttccctcattgactggtgaggccagagttacgcagaccccaggtgtgtaggttgggagggagactgtcctggagcctcctctgcattattttttgaccattctgtgaatgtaaggatctgcctgaatgatgctatctctgttcaggctctcttcaggctcctcgggactggggctgtgtaaccccctttgcctgagcctctggattcttcagggcacagaccctgctttagtggagggacccaggcaggggcagaatgtcttccacccacccaccagcaggcttctccttaagtcttctgctggactctcagagttctcttattaagataactgggggcagcagaacattctttttaggtactgttgtccattctcctgagagtccagggggctgtggtctccttcctccccccttgccctgtccccagcaaatggcctttaaaggtctggagccaggttaccgatgaggaggcctaggttcccttcctctttgcttctgggagcatctcgagcagtgcagagtggcttcccagccccagatggcaggattggggtgggtttgggatctgctgcctttgctcagtgtgcagggttggggtggaaatgggggacaggctagggcctctgcattaggctgccttcttaggcaggtgggctttcacttccagctcctcttccattttcacgatgtccttcttcctaggcactgcgaggggaggagaaaaggggctttgcagaggcctgggagtattcccaggaagtgcctggttggcgaaacaaccagggagctgctcctgggagctgggctgaggctttgctgggctgcctctcccactcacccttctcccggcccccaccatgccttccccatgggggaggggcagggggctggaggaacacagcttccccctgttctagcagagaaatgctggctgtatgcctcccctagggttcccaggctgactagggtgtggctggccttctgatggagcccactcatgctgggccgctgcccaggggctttgtggcacctaggtcgagatggtactcaggccaggggtcaggattcctgggtgctctggtcccggtgcctctgtctcatctttaggctgggattcctgccaccttgctgctcgggggcccaaatactttgagacaaggctataggcttgtcccactgactctcctttccctccctggggtctcctctctctccagagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccgtacacctggaagtcctcgaacttgaaggaggcagagcaggggaggtggctga

SEQ ID NO: 304678 - DNA, 2498 bp, Homo sapiens
cggggagtcccagtggcggaggctacgaaacttgggggagtgcacagaagaacttcgggagcgcacgcgggaccaggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304679 - DNA, 3243 bp, Homo sapiens
cggggagtcccagtggcggaggctacgaaacttgggggagtgcacagaagaacttcgggagcgcacgcgggaccaggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304680 - DNA, 5448 bp, Homo sapiens
gagctttggcgctgctgggatccgtacgattctaactgggattggatttccaaaaggccctccttcctcccagcctgtcagctccctcccagtgtcccggttgttttcttaacactttagaggctgtggctgagttggcaggggttccccaccctgaactttctgtctgaggtgcgttaggaagcctccggatcattgaaggaagtgactggcttggtggctgacctgtggagggctgcttgctgtgtattgaataaaggaggcttcttggggtcggggcagggtctctgtaagcacagggagaattgatttcgctggggcttggatcacgtgtgtgtgtgtgtgtgtgtgtgtgtgtgtgtgagagagagagagagagagagagaaagagagacagaggtggaaacccttgtccttggggatcctggatagaagttgccagtgttggagtcttggggcggtgctgcctagaggatacctcccaaccattccagctccagatgctgatcatccctatgccccctcccccagtagtctctgttggatcttacaggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatgtaggtccatatcttgtgttgttaagaacctgcatgaagggggagggactgatgggggttgatccggatgtgggacgtccaggtggagaaacaggatttgaataaggcaggaacaagcgcccagttctgcccaactgctgtctttcctccttcacccccagcccatccctggccaggctgtcctagtgcaggcagatgtggccaccctcacctctcgcagggtgctgcatgcctgtggactggtgccactgggtgtgtggggcctgagctacaagggtctctgttgtcttggttgtcaggctaggggtggaggtgccctgttcagggcctgtggagttagaaggaaggctaggaccagagaggacttcctgggctcttggccaggaggtggtgacagcctttgcccccatcactgcaccccttgattatggtactctgttcctgcttgatttcttctccagcttccctcattgactggtgaggccagagttacgcagaccccaggtgtgtaggttgggagggagactgtcctggagcctcctctgcattattttttgaccattctgtgaatgtaaggatctgcctgaatgatgctatctctgttcaggctctcttcaggctcctcgggactggggctgtgtaaccccctttgcctgagcctctggattcttcagggcacagaccctgctttagtggagggacccaggcaggggcagaatgtcttccacccacccaccagcaggcttctccttaagtcttctgctggactctcagagttctcttattaagataactgggggcagcagaacattctttttaggtactgttgtccattctcctgagagtccagggggctgtggtctccttcctccccccttgccctgtccccagcaaatggcctttaaaggtctggagccaggttaccgatgaggaggcctaggttcccttcctctttgcttctgggagcatctcgagcagtgcagagtggcttcccagccccagatggcaggattggggtgggtttgggatctgctgcctttgctcagtgtgcagggttggggtggaaatgggggacaggctagggcctctgcattaggctgccttcttaggcaggtgggctttcacttccagctcctcttccattttcacgatgtccttcttcctaggcactgcgaggggaggagaaaaggggctttgcagaggcctgggagtattcccaggaagtgcctggttggcgaaacaaccagggagctgctcctgggagctgggctgaggctttgctgggctgcctctcccactcacccttctcccggcccccaccatgccttccccatgggggaggggcagggggctggaggaacacagcttccccctgttctagcagagaaatgctggctgtatgcctcccctagggttcccaggctgactagggtgtggctggccttctgatggagcccactcatgctgggccgctgcccaggggctttgtggcacctaggtcgagatggtactcaggccaggggtcaggattcctgggtgctctggtcccggtgcctctgtctcatctttaggctgggattcctgccaccttgctgctcgggggcccaaatactttgagacaaggctataggcttgtcccactgactctcctttccctccctggggtctcctctctctccagagatgccctgtatccaagcccaatatgggacaccagcaccgagtccgggaccccgtgaccacctggcaagcgaccccctgacccctgagttcatcaatgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304681 - DNA, 3393 bp, Homo sapiens
cggggagtcccagtggcggaggctacgaaacttgggggagtgcacagaagaacttcgggagcgcacgcgggaccaggaccaggctgagactcggggcgccagtccgggcaggggcagcgggagccggccgggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304682 - DNA, 2980 bp, Homo sapiens
cggggagtcccagtggcggaggctacgaaacttgggggagtgcacagaagaacttcgggagcgcacgcgggaccaggaccaggctgagactcggggcgccagtccgggcaggggcagcgggagccggccgggtaggttcccttcggggaacgtgcatctgtttttaggagcggtgcatgaaggagatgggtgtacgcgcgggcagagaggatgttgtagggccggcatgcaagagggtaggtgtagtgtgcagctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304683 - DNA, 1942 bp, Homo sapiens
cccacactctgacagcttgttccgtgttgcccccccacccagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304684 - DNA, 1546 bp, Homo sapiens
cggggagtcccagtggcggaggctacgaaacttgggggagtgcacagaagaacttcgggagcgcacgcgggaccaggaccaggctgagactcggggcgccagtccgggcaggggcagcgggagccggccgggtaggttcccttcggggaacgtgcatctgtttttaggagcggtgcatgaaggagatgggtgtacgcgcgggcagagaggatgttgtagggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304685 - DNA, 957 bp, Homo sapiens
cgttgctcctggtggtatcatcccaggacaggaagagcaagagcatgcaggagtacagcagtgtgagaaagaaaatgcctggtcagaccatgtgaggtggctcacacctgtaatccccacactttgggaggccgtggcatggaggatcacttgagcctaggagctcgggaccaggcctgggcaaacatggctgaaaccctgtctgtacaaaaatacagaaaattagtcagcgtggtggtgctgtgcctgtggccccagctacttggagtatgaggataatgagggttactgcttctcagacttgtgacgatgcttactaatggccaacatgtgaatgcgcttttgtgaagtgccagcagagcatgaggggtggtcaggggcagcagttttaggggcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaa

SEQ ID NO: 304686 - DNA, 2205 bp, Homo sapiens
cggggagtcccagtggcggaggctacgaaacttgggggagtgcacagaagaacttcgggagcgcacgcgggaccaggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtaaagatgggtcagatggacttgcagggtgaaatgggatggtacttgcagggtgagatgggatggtactcacttgagggtttgagatgtgggggatgtactgctgggtgagataggatgt

SEQ ID NO: 304687 - DNA, 1664 bp, Homo sapiens
cggggagtcccagtggcggaggctacgaaacttgggggagtgcacagaagaacttcgggagcgcacgcgggaccaggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgggccctgagtccaggtgtgca

SEQ ID NO: 304688 - DNA, 3282 bp, Homo sapiens
  misc_feature (1375)..(1375): n is a, c, g, or t
acagcaagttgtattcattccattcatctagaattcctaggctgcctttgtcgggcctgcaggtattaatggagaatagcagctttttatttttttatatttattttttgagacagagtctcactctgttgcccaggctggagtgcaatggcgcgatctcagctcactgcagcctccgcctcagaggttcaagtgattctcctgcctcagcctctggaatagctgggactacaggcacctgccaccacacccagctaactttttgtatttttagagaagatggggtttcatcatgttggccaagctggtctcaaactcctgatctcagtgatccatctgcctcagcctcccaaagttataagatttttttcctctggtttttagtaaatgttttttttgagattgcttagcaccagaatgatttgcaaatttgaaaataggaactccactaggaatgccggatagaagagtgcttcacatttgtagagggagacaagaactaaatatcacgacgtctttctgagccttttggtttgctaacgtgccccaaattcttattccaaacggtataagataattatgtgtaaatgaataccagctctacttagttttatttcatatttgtgtatctgaatatattaaaatatctttttttttttttttgatgcggagtcttgctctgttgtccagcctggagtgcagtggcatgatctcggctcactgcaacctctgcctcccaggttcaagcgattctcctgcctcagcctcctaagtagctggtattacaggagtgtgccattagcctggctaatttttgtatttttagtagagatggattttcattgtgttggccatgctggtcttgaactcctgacctcaagtgatcctcctgccttggcctcccaaagtactgtgattactatcatgagccaccacacctggcctaaaagatcattgatttagttttgagtaagattttaagtgattaaattatggtattgttgtgtctggaatatctgatattagggtttttttttttttttttttacagtttttgatatgctttattttgggtatgtagtttacaaaatataaaggaaatataaggagtgttctcttttttttttaaataaaaagtgtatttttaactgggcatggtggctcactcctgtaaccccagcactgtgggaggctgaggctggtgaatcgcctgagtccaggagtttgagaccagcctgggcaacaaggtgaaaccctgtttctatcaaaaaaaaaaaaaaaaaaaaaaggaaaaaaaataagtcaggcatggtggtatgcacctgtagtcccagctacttgaaggctgaggcaggaggatcgcttgtgcctgggnggttgaagctacagtgagctatggtcaagctactgcactccattataggcaaccctatctcaaaaaagcaaagcaaaacaaaacatttttccccttgattatagaggtttgagaaaaatttgagggaagattcagaaaattacctgtaactgaacagaatgccaccagcttgggcttattctgcatgcataattatgaacattttcccagctcttgtgaaaattctcacattcatagaaagatagatgcaccagtaaaataaatacctgtaaatacgataataatttcataataatatgcttcacctagatttaccagttactaatattttgccagttttattttctcacacacttttgttgagcatctgaaaaccatacacatgatgacagttcaacccataatgttttagtttgcatctcccaagaataaggtttttcttctgtataacaagaatattgtaatcatacctaagaaaatgaattttattacatatgtgttctatattcaaatttctgtaattacccctaagatgtcttttaaatgatttttagcattgatagtctgtgcctgtgtagattataacattggctattgcaaaataatggttttctttttctctttttttttgagacgaaatcttgctctattgtccaagctggagggcagtggcacaatctcggctcactgcaacctccgcctcccaggttcaagcagttctcatgcttcaccctcctgagtagctgggattacaggcaggtgccactgtgctctgctaatttttatatttttagtagagacggagtttcatcgagctggccagactggtcttgaactcctgacctcaagtgatccacctgcctcgtcctcccaaagtgctggggttacaggtgtgagccactgcacccagcctaaaatgatggttttctgattctagcatttcttttataagattgctatgtaaagcacagcttttctttttttagggaaaaatgtcttttaacagctgcaaaataaatattctttcaatggaatgacaattattatttttgccatatatttattttaaaaatttatgtataatggtaacctgagcctgcatgttattcatgtgtggtgccatactgatctttaattttaatgtgaagcaagtactaatatagtaaagcataaattatataaaatttgctttatattttggattgcaaattaattgctgtactttatagaaaagtttcccaaatccgttttacttttttgtatttgaaatttaatcacaggtggaatcttaaagagagcatttagggatattgtaaacagatgttattaaggactaatgttaacaaacattgaagaagagaaaacagtatttgtttttagcttaacatcttagtggagtgaaatattttcagtatatttattttatttatttattaattatttttttttttgagatggagtctggctgtattgtccaggctggagtgcagcggtgcaatctcagctcactgcaacctctgcctcctgggttcaagcgattcttgtgtctcagcctcccgagtagttgggatttacaagtcaattttttttttaactaaaactacagaatctatttttcttggtctcatactcagttttttatgtagtcacttagtaaataacctaatttgcttgttttctccacactaattttagggtgaattcctcatttcgcttttcagatcatggggtgagggggatggttgtgtgtgtgaggaactgaggaatcagatggaaaacaatgcctctgctcctttgagtataatcagtgatatttgaggttccagggttaaatgctgcatttttatttctgacgttcgtaccttaaaatatttgaagaaaataaactatttcattgttgtcagaaa

SEQ ID NO: 304689 - DNA, 3547 bp, Homo sapiens
  misc_feature (1375)..(1375): n is a, c, g, or t
acagcaagttgtattcattccattcatctagaattcctaggctgcctttgtcgggcctgcaggtattaatggagaatagcagctttttatttttttatatttattttttgagacagagtctcactctgttgcccaggctggagtgcaatggcgcgatctcagctcactgcagcctccgcctcagaggttcaagtgattctcctgcctcagcctctggaatagctgggactacaggcacctgccaccacacccagctaactttttgtatttttagagaagatggggtttcatcatgttggccaagctggtctcaaactcctgatctcagtgatccatctgcctcagcctcccaaagttataagatttttttcctctggtttttagtaaatgttttttttgagattgcttagcaccagaatgatttgcaaatttgaaaataggaactccactaggaatgccggatagaagagtgcttcacatttgtagagggagacaagaactaaatatcacgacgtctttctgagccttttggtttgctaacgtgccccaaattcttattccaaacggtataagataattatgtgtaaatgaataccagctctacttagttttatttcatatttgtgtatctgaatatattaaaatatctttttttttttttttgatgcggagtcttgctctgttgtccagcctggagtgcagtggcatgatctcggctcactgcaacctctgcctcccaggttcaagcgattctcctgcctcagcctcctaagtagctggtattacaggagtgtgccattagcctggctaatttttgtatttttagtagagatggattttcattgtgttggccatgctggtcttgaactcctgacctcaagtgatcctcctgccttggcctcccaaagtactgtgattactatcatgagccaccacacctggcctaaaagatcattgatttagttttgagtaagattttaagtgattaaattatggtattgttgtgtctggaatatctgatattagggtttttttttttttttttttacagtttttgatatgctttattttgggtatgtagtttacaaaatataaaggaaatataaggagtgttctcttttttttttaaataaaaagtgtatttttaactgggcatggtggctcactcctgtaaccccagcactgtgggaggctgaggctggtgaatcgcctgagtccaggagtttgagaccagcctgggcaacaaggtgaaaccctgtttctatcaaaaaaaaaaaaaaaaaaaaaaggaaaaaaaataagtcaggcatggtggtatgcacctgtagtcccagctacttgaaggctgaggcaggaggatcgcttgtgcctgggnggttgaagctacagtgagctatggtcaagctactgcactccattataggcaaccctatctcaaaaaagcaaagcaaaacaaaacatttttccccttgattatagaggtttgagaaaaatttgagggaagattcagaaaattacctgtaactgaacagaatgccaccagcttgggcttattctgcatgcataattatgaacattttcccagctcttgtgaaaattctcacattcatagaaagatagatgcaccagtaaaataaatacctgtaaatacgataataatttcataataatatgcttcacctagatttaccagttactaatattttgccagttttattttctcacacacttttgttgagcatctgaaaaccatacacatgatgacagttcaacccataatgttttagtttgcatctcccaagaataaggtttttcttctgtataacaagaatattgtaatcatacctaagaaaatgaattttattacatatgtgttctatattcaaatttctgtaattacccctaagatgtcttttaaatgatttttagcattgatagtctgtgcctgtgtagattataacattggctattgcaaaataatggttttctttttctctttttttttgagacgaaatcttgctctattgtccaagctggagggcagtggcacaatctcggctcactgcaacctccgcctcccaggttcaagcagttctcatgcttcaccctcctgagtagctgggattacaggcaggtgccactgtgctctgctaatttttatatttttagtagagacggagtttcatcgagctggccagactggtcttgaactcctgacctcaagtgatccacctgcctcgtcctcccaaagtgctggggttacaggtgtgagccactgcacccagcctaaaatgatggttttctgattctagcatttcttttataagattgctatgtaaagcacagcttttctttttttagggaaaaatgtcttttaacagctgcaaaataaatattctttcaatggaatgacaattattatttttgccatatatttattttaaaaatttatgtataatggtaacctgagcctgcatgttattcatgtgtggtgccatactgatctttaattttaatgtgaagcaagtactaatatagtaaagcataaattatataaaatttgctttatattttggattgcaaattaattgctgtactttatagaaaagtttcccaaatccgttttacttttttgtatttgaaatttaatcacaggtggaatcttaaagagagcatttagggatattgtaaacagatgttattaaggactaatgttaacaaacattgaagaagagaaaacagtatttgtttttagcttaacatcttagtggagtgaaatattttcagtatatttattttatttatttattaattatttttttttttgagatggagtctggctgtattgtccaggctggagtgcagcggtgcagtgagccgagatggcaccactgcactccagcttgttgacagaatgagaccctgtggaaaaaaaaaaaaaaaagccctcccatgccagaacagaggatggcagtctgtttcaataagacactgtgtccttggtgttggttctgattaagactcactgagatccagtgctcttgagctgggtctcagtcccctcccatgtcctgtgctctgccgccactgttttcattgttgtgttctcgttgtgattgttaagactcacactcctggctcagcagtggttttccagaaggcccaaagagcggtgccgggcaccccacgtcgcagtgtccgttccgggcttgggaagctggggaggtgggcagacctggtcgcatctcaccacacacacacacacacacacacacacacacacacacacacacacacacgctgtcagaaactcggccgtcccccctacctctgagctctcaatgctgctaatctctgccaagtgtccctgtgctccagcaccttccttgaaggactgacgcccaccccacgctctttgcgaggttgtccaggctgtgtttgtcgcatgctcttcttctgtatagttctcatcttccaattttatgggattcaacaaaagcctattatgcttgtttgcattatggttacaatattaaaaagtggattc

SEQ ID NO: 304690 - DNA, 1895 bp, Homo sapiens
gaggacccatcagtttacacaaaaaacaaattaataaaatatcttcatatataaattaagctaattaaaaacatttttccccttgattatagaggtttgagaaaaatttgagggaagattcagaaaattacctgtaactgaacagaatgccaccagcttgggcttattctgcatgcataattatgaacattttcccagctcttgtgaaaattctcacattcatagaaagatagatgcaccagtaaaataaatacctgtaaatacgataataatttcataataatatgcttcacctagatttaccagttactaatattttgccagttttattttctcacacacttttgttgagcatctgaaaaccatacacatgatgacagttcaacccataatgttttagtttgcatctcccaagaataaggtttttcttctgtataacaagaatattgtaatcatacctaagaaaatgaattttattacatatgtgttctatattcaaatttctgtaattacccctaagatgtcttttaaatgatttttagcattgatagtctgtgcctgtgtagattataacattggctattgcaaaataatggttttctttttctctttttttttgagacgaaatcttgctctattgtccaagctggagggcagtggcacaatctcggctcactgcaacctccgcctcccaggttcaagcagttctcatgcttcaccctcctgagtagctgggattacaggcaggtgccactgtgctctgctaatttttatatttttagtagagacggagtttcatcgagctggccagactggtcttgaactcctgacctcaagtgatccacctgcctcgtcctcccaaagtgctggggttacaggtgtgagccactgcacccagcctaaaatgatggttttctgattctagcatttcttttataagattgctatgtaaagcacagcttttctttttttagggaaaaatgtcttttaacagctgcaaaataaatattctttcaatggaatgacaattattatttttgccatatatttattttaaaaatttatgtataatggtaacctgagcctgcatgttattcatgtgtggtgccatactgatctttaattttaatgtgaagcaagtactaatatagtaaagcataaattatataaaatttgctttatattttggattgcaaattaattgctgtactttatagaaaagtttcccaaatccgttttacttttttgtatttgaaatttaatcacaggtggaatcttaaagagagcatttagggatattgtaaacagatgttattaaggactaatgttaacaaacattgaagaagagaaaacagtatttgtttttagcttaacatcttagtggagtgaaatattttcagtatatttattttatttatttattaattatttttttttttgagatggagtctggctgtattgtccaggctggagtgcagcggtgcaatctcagctcactgcaacctctgcctcctgggttcaagcgattcttgtgtctcagcctcccgagtagttgggatttacaagtcaattttttttttaactaaaactacagaatctatttttcttggtctcatactcagttttttatgtagtcacttagtaaataacctaatttgcttgttttctccacactaattttagggtgaattcctcatttcgcttttcagatcatggggtgagggggatggttgtgtgtgtgaggaactgaggaatcagatggaaaacaatgcctctgctcctttgagtataatcagtgatatttgaggttccagggttaaatgctgcatttttatttctgacgttcgtaccttaaaatatttgaagaaaataaactatttcattgttgtcagaaa

SEQ ID NO: 304691 - DNA, 3297 bp, Homo sapiens
  misc_feature (1375)..(1375): n is a, c, g, or t
acagcaagttgtattcattccattcatctagaattcctaggctgcctttgtcgggcctgcaggtattaatggagaatagcagctttttatttttttatatttattttttgagacagagtctcactctgttgcccaggctggagtgcaatggcgcgatctcagctcactgcagcctccgcctcagaggttcaagtgattctcctgcctcagcctctggaatagctgggactacaggcacctgccaccacacccagctaactttttgtatttttagagaagatggggtttcatcatgttggccaagctggtctcaaactcctgatctcagtgatccatctgcctcagcctcccaaagttataagatttttttcctctggtttttagtaaatgttttttttgagattgcttagcaccagaatgatttgcaaatttgaaaataggaactccactaggaatgccggatagaagagtgcttcacatttgtagagggagacaagaactaaatatcacgacgtctttctgagccttttggtttgctaacgtgccccaaattcttattccaaacggtataagataattatgtgtaaatgaataccagctctacttagttttatttcatatttgtgtatctgaatatattaaaatatctttttttttttttttgatgcggagtcttgctctgttgtccagcctggagtgcagtggcatgatctcggctcactgcaacctctgcctcccaggttcaagcgattctcctgcctcagcctcctaagtagctggtattacaggagtgtgccattagcctggctaatttttgtatttttagtagagatggattttcattgtgttggccatgctggtcttgaactcctgacctcaagtgatcctcctgccttggcctcccaaagtactgtgattactatcatgagccaccacacctggcctaaaagatcattgatttagttttgagtaagattttaagtgattaaattatggtattgttgtgtctggaatatctgatattagggtttttttttttttttttttacagtttttgatatgctttattttgggtatgtagtttacaaaatataaaggaaatataaggagtgttctcttttttttttaaataaaaagtgtatttttaactgggcatggtggctcactcctgtaaccccagcactgtgggaggctgaggctggtgaatcgcctgagtccaggagtttgagaccagcctgggcaacaaggtgaaaccctgtttctatcaaaaaaaaaaaaaaaaaaaaaaggaaaaaaaataagtcaggcatggtggtatgcacctgtagtcccagctacttgaaggctgaggcaggaggatcgcttgtgcctgggnggttgaagctacagtgagctatggtcaagctactgcactccattataggcaaccctatctcaaaaaagcaaagcaaaacaaaacatttttccccttgattatagaggtttgagaaaaatttgagggaagattcagaaaattacctgtaactgaacagaatgccaccagcttgggcttattctgcatgcataattatgaacattttcccagctcttgtgaaaattctcacattcatagaaagatagatgcaccagtaaaataaatacctgtaaatacgataataatttcataataatatgcttcacctagatttaccagttactaatattttgccagttttattttctcacacacttttgttgagcatctgaaaaccatacacatgatgacagttcaacccataatgttttagtttgcatctcccaagaataaggtttttcttctgtataacaagaatattgtaatcatacctaagaaaatgaattttattacatatgtgttctatattcaaatttctgtaattacccctaagatgtcttttaaatgatttttagcattgatagtctgtgcctgtgtagattataacattggctattgcaaaataatggttttctttttctctttttttttgagacgaaatcttgctctattgtccaagctggagggcagtggcacaatctcggctcactgcaacctccgcctcccaggttcaagcagttctcatgcttcaccctcctgagtagctgggattacaggcaggtgccactgtgctctgctaatttttatatttttagtagagacggagtttcatcgagctggccagactggtcttgaactcctgacctcaagtgatccacctgcctcgtcctcccaaagtgctggggttacaggtgtgagccactgcacccagcctaaaatgatggttttctgattctagcatttcttttataagattgctatgtaaagcacagcttttctttttttagggaaaaatgtcttttaacagctgcaaaataaatattctttcaatggaatgacaattattatttttgccatatatttattttaaaaatttatgtataatggtaacctgagcctgcatgttattcatgtgtggtgccatactgatctttaattttaatgtgaagcaagtactaatatagtaaagcataaattatataaaatttgctttatattttggattgcaaattaattgctgtactttatagaaaagtttcccaaatccgttttacttttttgtatttgaaatttaatcacaggtggaatcttaaagagagcatttagggatattgtaaacagatgttattaaggactaatgttaacaaacattgaagaagagaaaacagtatttgtttttagcttaacatcttagtggagtgaaatattttcagtatatttattttatttatttattaattatttttttttttgagatggagtctggctgtattgtccaggctggagtgcagcggtgcaatctcagctcactgcaacctctgcctcctgggttcaagcgattcttgtgtctcagcctcccgagtagttgggatttacaagtcaattttttttttaactaaaactacagaatctatttttcttggtctcatactcagttttttatgtagtcacttagtaaataacctaatttgcttgttttctccacactaattttagggtgaattcctcatttcgcttttcagatcatggggtgagggggatggttgtgtgtgtgaggaactgaggaatcagatggaaaacaatgcctctgctcctttgagtataatcagtgatatttgaggttccagggttaaatgctgcatttttatttctgacgttcgtaccttaaccgagggctcgaaaattgggtatttaacggttgttccaagtgctacacccttttc

SEQ ID NO: 304692 - DNA, 2958 bp, Homo sapiens
  misc_feature (1375)..(1375): n is a, c, g, or t
  misc_feature (2934)..(2934): n is a, c, g, or t
acagcaagttgtattcattccattcatctagaattcctaggctgcctttgtcgggcctgcaggtattaatggagaatagcagctttttatttttttatatttattttttgagacagagtctcactctgttgcccaggctggagtgcaatggcgcgatctcagctcactgcagcctccgcctcagaggttcaagtgattctcctgcctcagcctctggaatagctgggactacaggcacctgccaccacacccagctaactttttgtatttttagagaagatggggtttcatcatgttggccaagctggtctcaaactcctgatctcagtgatccatctgcctcagcctcccaaagttataagatttttttcctctggtttttagtaaatgttttttttgagattgcttagcaccagaatgatttgcaaatttgaaaataggaactccactaggaatgccggatagaagagtgcttcacatttgtagagggagacaagaactaaatatcacgacgtctttctgagccttttggtttgctaacgtgccccaaattcttattccaaacggtataagataattatgtgtaaatgaataccagctctacttagttttatttcatatttgtgtatctgaatatattaaaatatctttttttttttttttgatgcggagtcttgctctgttgtccagcctggagtgcagtggcatgatctcggctcactgcaacctctgcctcccaggttcaagcgattctcctgcctcagcctcctaagtagctggtattacaggagtgtgccattagcctggctaatttttgtatttttagtagagatggattttcattgtgttggccatgctggtcttgaactcctgacctcaagtgatcctcctgccttggcctcccaaagtactgtgattactatcatgagccaccacacctggcctaaaagatcattgatttagttttgagtaagattttaagtgattaaattatggtattgttgtgtctggaatatctgatattagggtttttttttttttttttttacagtttttgatatgctttattttgggtatgtagtttacaaaatataaaggaaatataaggagtgttctcttttttttttaaataaaaagtgtatttttaactgggcatggtggctcactcctgtaaccccagcactgtgggaggctgaggctggtgaatcgcctgagtccaggagtttgagaccagcctgggcaacaaggtgaaaccctgtttctatcaaaaaaaaaaaaaaaaaaaaaaggaaaaaaaataagtcaggcatggtggtatgcacctgtagtcccagctacttgaaggctgaggcaggaggatcgcttgtgcctgggnggttgaagctacagtgagctatggtcaagctactgcactccattataggcaaccctatctcaaaaaagcaaagcaaaacaaaacatttttccccttgattatagaggtttgagaaaaatttgagggaagattcagaaaattacctgtaactgaacagaatgccaccagcttgggcttattctgcatgcataattatgaacattttcccagctcttgtgaaaattctcacattcatagaaagatagatgcaccagtaaaataaatacctgtaaatacgataataatttcataataatatgcttcacctagatttaccagttactaatattttgccagttttattttctcacacacttttgttgagcatctgaaaaccatacacatgatgacagttcaacccataatgttttagtttgcatctcccaagaataaggtttttcttctgtataacaagaatattgtaatcatacctaagaaaatgaattttattacatatgtgttctatattcaaatttctgtaattacccctaagatgtcttttaaatgatttttagcattgatagtctgtgcctgtgtagattataacattggctattgcaaaataatggttttctttttctctttttttttgagacgaaatcttgctctattgtccaagctggagggcagtggcacaatctcggctcactgcaacctccgcctcccaggttcaagcagttctcatgcttcaccctcctgagtagctgggattacaggcaggtgccactgtgctctgctaatttttatatttttagtagagacggagtttcatcgagctggccagactggtcttgaactcctgacctcaagtgatccacctgcctcgtcctcccaaagtgctggggttacaggtgtgagccactgcacccagcctaaaatgatggttttctgattctagcatttcttttataagattgctatgtaaagcacagcttttctttttttagggaaaaatgtcttttaacagctgcaaaataaatattctttcaatggaatgacaattattatttttgccatatatttattttaaaaatttatgtataatggtaacctgagcctgcatgttattcatgtgtggtgccatactgatctttaattttaatgtgaagcaagtactaatatagtaaagcataaattatataaaatttgctttatattttggattgcaaattaattgctgtactttatagaaaagtttcccaaatccgttttacttttttgtatttgaaatttaatcacaggtggaatcttaaagagagcatttagggatattgtaaacagatgttattaaggactaatgttaacaaacattgaagaagagtatttattttatttatttattaattatttttttttttgagatggagtctggctgtattgtccaggctggagtgcagcggtgcaatctcagctcactgcaacctctgcctcctgggttcaagcgattcttgggaggctgaagcaggaggatcacttcagccagggaggttgagactgcagtgaaccatgatcatgcactntagtctgggcaatagagtgagacc

SEQ ID NO: 304693 - DNA, 570 bp, Homo sapiens
tgtttaggatattattttgcagcttgtaaagacatttttccctaaaaaaagaaaagctgtgctttacatagcaatcttataaaagaaatgctagaatcagaaaaccatcattttaggctgggtgcagtggctcacacctgtaaccccagcactttgggaggacgaggcaggtggatcacttgagctcctgggttcaagcgattcttgtgtctcagcctcccgagtagttgggatttacaagtcaattttttttttaactaaaactacagaatctatttttcttggtctcatactcagttttttatgtagtcacttagtaaataacctaatttgcttgttttctccacactaattttagggtgaattcctcatttcgcttttcagatcatggggtgagggggatggttgtgtgtgtgaggaactgaggaatcagatggaaaacaatgcctctgctcctttgagtataatcagtgatatttgaggttccagggttaaatgctgcatttttatttctgacgttcgtaccttaaaatatttgaagaaaataaactatttcattgttgtcagaaa

SEQ ID NO: 304694 - DNA, 349 bp, Homo sapiens
attctagggtactgggagttaggtcgtccacatatcattttttggaggacacaactgaacacatgacaaatactgaaagatttaaaaattgtaatgtgcagtttcataatttaatccataagcaataagtgggataggctaggcatggggcctcacacctgtaatcctagcactttgggagtctgaggcaggcggatcacctgagatcaggagtttgagaccagcctggtcaacatggcgaaaccccgtctctactaaaaatacaaaaattaaccagatgtggtggtgcatgcctgtaatcccagctactcgggaggctgaggcaagagaatcactttaacccaggagg

SEQ ID NO: 304695 - DNA, 545 bp, Homo sapiens
tgaggcgggtcccttttagaccgccagtcttgtgggtccctcgcacagcgcggattttcgggcgggaagaccggaatgcggtttgtgagtgtggtccccgcgcaccggtagccagccgaaagcacctctttccagcaagctgcctggcccagggaccaactggcatttgcccctatgtggatagaaaattaattttcattaaaagctcccagaggtcaggttctatacagtgccagcagcagatggaggtgtaatgatccaaacgagttcagtttggacaaagtagcatagtgactttttttctacattgactttcggagaagttggcagattctggcaaagtgacgctgggctgtttgaaaaaggcaagcttagcctaggctgccatcttaaaatatttcgaggctgtagctgcctcaggatcctttgcctgtggtctggtggccggcagtgccccgctaacagctttaactctgcacttagtgcctgagcacctatggctgtgagagatgctagatacagaaccctgtccttaccacgtgggg

SEQ ID NO: 304696 - DNA, 5231 bp, Homo sapiens
tgaaggaaaatttgtattatttcaattatttttatgtacagaaaactcaacagtgtacatttaacccagtttagtggcaagttctttagcctttgccttttcgagcttggcgatacgagccacagacttaggacccaggacattgccaccccagtgacggcggatctcatcgtatctgtcattgtaattggtcctgatagcttccaccagcttagccaaagcgcctttgtcttccgagttcacctgtgtgaaggcgacagtggtgcaggtcttcctgtggactagacgtcccagtcttgcctttcccttgataatgcagtaagggacccccattttacgacacagggcaggcaagaagacaaccagctcgatgggatccacgtcgtgtgcaatcaccaccagctgagctttcttgttctccaccaaggtggtgacggtgttaactcctgctcgaaggacaggtggtctcttcgttgggacgtcccctttgccagcagccttcttctcggcccgggccaacagtctctgcttcttctcttgctttgtctctggtctgtacttgtgggccagcttaagcagctgagtagctgtttggcggtccagggcctgggtgaactggttaatcgcaggaggcactttcagccgcttatagaggatggctctctgccgctgcaacctgatatagcggggccatttcacaaagcgggtgaggtctcttttgggctggatgtcctgtccaatgccaaaattcttaggccttttctcaaacaggggattcaccactttcttagcctcctgcttcttcacgacagctggggccggagccaccttctttcccttggccttctttcctttctgtctgcggtggcggcggcgcctctcgtctcccgcggcccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctca

SEQ ID NO: 304697 - DNA, 4494 bp, Homo sapiens
agcggggcgttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcggcccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctca

SEQ ID NO: 304698 - DNA, 4313 bp, Homo sapiens
ctgatactattgaagtacaacagatgaaggctcaggctagggaggagaaacatcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctca

SEQ ID NO: 304699 - DNA, 5177 bp, Homo sapiens
tgaaggaaaatttgtattatttcaattatttttatgtacagaaaactcaacagtgtacatttaacccagtttagtggcaagttctttagcctttgccttttcgagcttggcgatacgagccacagacttaggacccaggacattgccaccccagtgacggcggatctcatcgtatctgtcattgtaattggtcctgatagcttccaccagcttagccaaagcgcctttgtcttccgagttcacctgtgtgaaggcgacagtggtgcaggtcttcctgtggactagacgtcccagtcttgcctttcccttgataatgcagtaagggacccccattttacgacacagggcaggcaagaagacaaccagctcgatgggatccacgtcgtgtgcaatcaccaccagctgagctttcttgttctccaccaaggtggtgacggtgttaactcctgctcgaaggacaggtggtctcttcgttgggacgtcccctttgccagcagccttcttctcggcccgggccaacagtctctgcttcttctcttgctttgtctctggtctgtacttgtgggccagcttaagcagctgagtagctgtttggcggtccagggcctgggtgaactggttaatcgcaggaggcactttcagccgcttatagaggatggctctctgccgctgcaacctgatatagcggggccatttcacaaagcgggtgaggtctcttttgggctggatgtcctgtccaatgccaaaattcttaggccttttctcaaacaggggattcaccactttcttagcctcctgcttcttcacgacagctggggccggagccaccttctttcccttggccttctttcctttctgtctgcggtggcggcggcgcctctcgtctcccgcggcccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctca

SEQ ID NO: 304700 - DNA, 4635 bp, Homo sapiens
agcggggcgttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcggcccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccatcttgctgtgttccccaggctggtctcaaactcctgacctcaagagatcctcccaccttggccttccaaagtgctgggactaaagatgtgaggcaccatgtccagctcttgctctgccttttaatatccacgtgtccttagatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctca

SEQ ID NO: 304701 - DNA, 431 bp, Homo sapiens
ccaaaaagaatttgatgtgactaggtctaattattgtaaacttaagatttttgttgattatacttgaaattatttttccaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcggtaagtgaaacatgcgtttgcattatattgtctgaaaattgtattctagaagtctataaataaaacgtttttcag

SEQ ID NO: 304702 - DNA, 448 bp, Homo sapiens
gattgctcgagcccatgagttcgaggctgcagtgagcttctgcacttcagcctgggcaacagagcgagaccctgtctcaagaaaacaaagaggtatatatgtatttacatgtgtgctaacttttagaaattgaacagatttgatttcttgctactattttagcttcttttgataatgagaatgattggaattaatcactgttggggggaatacacatatttcatagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagtaaggaactgtcttcttagagaaaaaagtttaaataaaagcatagagtgaaccctctaaa

SEQ ID NO: 304703 - DNA, 3642 bp, Homo sapiens
ccaggatctcctctgggggagttttctattaccagaaacttcattacatcagaatccaaactcatgatcctctcttgaaaacagacactcctcttgagctcctgggctttctcgtttcctcctttggtggtgccatgacgctcccagctgccctggcctgccatccttgctttgttgtgtccccagacacccacagtcagcaagtcctgctgaatcttcttccagagagttgttgaattccagcctgggtgacagaacgagactctgtctgaaaaaaaaaaaaggaggaatgatactacctgttaatgatactacctgttaggattattggggtattaaatgagatgatttgacaaagtgccatttaaagtatatagcattagataaatattttatcttttgtggactttaacaaatagtttattgatggaaattttttaaaaaagcttttaagttacacattttaagttcctgctactgaaagcaggattaactagtctgtagaataatagtaattttttaattttgtctccttagctcattacctaaaggacttattgtaaataagctatttaagatcttaagaaatactgtatttttttaaatggaaggctaagaaaaacataaacagcctaagcatgtgcattaaaactttgttgacttataagattattcaaaatatgttattttaattttggaattatattgtttactttaggcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctca

SEQ ID NO: 304704 - DNA, 4309 bp, Homo sapiens
catggattagatgacagaagactgatccagaagtcaggagcttcctgtctcatcccagccactaactaaaaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctca

SEQ ID NO: 304705 - DNA, 5466 bp, Homo sapiens
tgaaggaaaatttgtattatttcaattatttttatgtacagaaaactcaacagtgtacatttaacccagtttagtggcaagttctttagcctttgccttttcgagcttggcgatacgagccacagacttaggacccaggacattgccaccccagtgacggcggatctcatcgtatctgtcattgtaattggtcctgatagcttccaccagcttagccaaagcgcctttgtcttccgagttcacctgtgtgaaggcgacagtggtgcaggtcttcctgtggactagacgtcccagtcttgcctttcccttgataatgcagtaagggacccccattttacgacacagggcaggcaagaagacaaccagctcgatgggatccacgtcgtgtgcaatcaccaccagctgagctttcttgttctccaccaaggtggtgacggtgttaactcctgctcgaaggacaggtggtctcttcgttgggacgtcccctttgccagcagccttcttctcggcccgggccaacagtctctgcttcttctcttgctttgtctctggtctgtacttgtgggccagcttaagcagctgagtagctgtttggcggtccagggcctgggtgaactggttaatcgcaggaggcactttcagccgcttatagaggatggctctctgccgctgcaacctgatatagcggggccatttcacaaagcgggtgaggtctcttttgggctggatgtcctgtccaatgccaaaattcttaggccttttctcaaacaggggattcaccactttcttagcctcctgcttcttcacgacagctggggccggagccaccttctttcccttggccttctttcctttctgtctgcggtggcggcggcgcctctcgtctcccgcggcccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctcatgccttcaaggtccactgttgttatttaacatggattttttgtatgtttcttgaaaattacaatctttatcacagccatgaatcaccacaacttaaaagtaagaagtagataggaaataattttaaatcctcatagatctactctttccccgatacctctttggtatggaagtaatagtgattaattctgtggaaaagttaaattattaaattaaattgactttgttgacaacaa

SEQ ID NO: 304706 - DNA, 5240 bp, Homo sapiens
tgaaggaaaatttgtattatttcaattatttttatgtacagaaaactcaacagtgtacatttaacccagtttagtggcaagttctttagcctttgccttttcgagcttggcgatacgagccacagacttaggacccaggacattgccaccccagtgacggcggatctcatcgtatctgtcattgtaattggtcctgatagcttccaccagcttagccaaagcgcctttgtcttccgagttcacctgtgtgaaggcgacagtggtgcaggtcttcctgtggactagacgtcccagtcttgcctttcccttgataatgcagtaagggacccccattttacgacacagggcaggcaagaagacaaccagctcgatgggatccacgtcgtgtgcaatcaccaccagctgagctttcttgttctccaccaaggtggtgacggtgttaactcctgctcgaaggacaggtggtctcttcgttgggacgtcccctttgccagcagccttcttctcggcccgggccaacagtctctgcttcttctcttgctttgtctctggtctgtacttgtgggccagcttaagcagctgagtagctgtttggcggtccagggcctgggtgaactggttaatcgcaggaggcactttcagccgcttatagaggatggctctctgccgctgcaacctgatatagcggggccatttcacaaagcgggtgaggtctcttttgggctggatgtcctgtccaatgccaaaattcttaggccttttctcaaacaggggattcaccactttcttagcctcctgcttcttcacgacagctggggccggagccaccttctttcccttggccttctttcctttctgtctgcggtggcggcggcgcctctcgtctcccgcggcccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattacaagcattctgttcttagcatcctacttaaatccccatacactcatctactcttcggataccacgatgcgcgagggtacacgagctcgattctatctt

SEQ ID NO: 304707 - DNA, 1081 bp, Homo sapiens
agcggggcgttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcggcccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcggtaagtgaaacatgcgtttgcattatattgtctgaaaattgtattctagaagtctataaataaaacgtttttcaggtttttttttttttttggagacagggtctggacctgtcacccatgctggagtgcagtggcgtgatctcagcccactgcaacctctgcctcctgggttcaagccatccttccacctcagcctcctgagtagctgggtctataggcacatgccattatgtccgctaattttttttttaatgtatttttcattgagatggggtttcatcatgttgcccaggct

SEQ ID NO: 304708 - DNA, 4104 bp, Homo sapiens
tggctgaggggagcgagcggcgctttgggggaggggtcgcgtaggcgcctcacctgaccctgcggccgtgcggttgctgctccggggcaggtctccttccaggccaggggcccggaatcatgtacataaagcaggtgattatccagggttttcgaagttacagagatcaaacaattgtagatcccttcagttcaaaacataatgtgattgtgggcagaaatggatctggaaaaagtaactttttttatgcaattcagtttgttctcagtgatgagtttagtcatcttcgtccagaacagcggttggctttattgcatgaaggtactggtcctcgtgttatttctgcttttgtggagattatttttgataattcagacaaccggttaccaatcgataaagaggaagtttcacttcgaagagttattggtgccaaaaaggatcagtatttcttagacaagaagatggtcacgaaaaatgatgtgatgaacctccttgaaagcgctggtttttctcgaagcaatccttattatattgttaaacaaggaaagatcaaccagatggcaacagcaccagattctcagagattaaagctattaagagaagtagctggtactagagtgtatgacgaacgaaaggaagaaagcatctccttaatgaaagaaacagagggcaaacgggaaaaaatcaatgagttgttaaaatacattgaagagagattacatactctagaggaagaaaaggaagaactagctcagtatcagaagtgggataaaatgagacgagccctggaatataccatttacaatcaggaacttaacgagactcgtgccaaacttgatgagctttctgctaagcgagagactagtggagaaaaatccagacaattaagagatgctcagcaggatgcaagagataaaatggaggatatcgaacgccaagttagagaattgaaaacaaaaatttcagctatgaaagaagaaaaagaacagcttagtgctgaaagacaagagcagattaagcagaggactaagttggagcttaaagccaaggatttacaagatgaactagcaggcaatagtgaacaaaggaaacgtttattaaaagagaggcagaagctgcttgaaaaaatagaagaaaagcagaaagaactggcagaaacagaacccaaattcaacagtgtgaaagagaaagaagaacgaggaattgctagattggctcaagctacccaggaaagaacggatctttatgcaaagcagggtcgaggaagccagtttacatcaaaagaagaaagggataagtggattaaaaaggaactcaagtctttagatcaggctattaatgacaagaaaagacagattgctgctatacataaggatttggaagacactgaagcaaataaagagaaaaatctggagcagtataataaactggaccaggatcttaatgaagtcaaagctcgagtagaagaactggacagaaaatattacgaagtaaaaaataagaaagatgaactacaaagtgaaagaaactacttgtggagagaagagaatgcagaacagcaagcacttgctgctaaaagagaagatcttgaaaagaagcaacaacttcttagagcagcaacaggaaaggccattttaaatggaatagacagcataaacaaagtgctagaccacttccgtcgaaaaggaataaaccagcatgttcaaaatggctatcatggtattgtaatgaataactttgaatgtgaaccagctttctacacatgcgtggaagtcactgctggaaacaggttattttatcacattgttgattcagatgaagtcagcacgaagattttaatggagtttaataaaatgaatcttcctggagaggttacttttctgcctcttaacaagttagatgtcagggatacagcctatcctgaaaccaatgatgctattcctatgatcagcaaactgaggtacaatcccagatttgacaaagctttcaaacatgtgtttggaaagactcttatttgtcgtagcatggaagtttcaacccagctggcccgtgctttcactatggactgtattactttggaaggtgaccaagtcagccatcggggtgctctaactgggggttattatgacacaaggaagtctcgacttgaattgcaaaaagatgttagaaaagcagaagaagaactaggtgaacttgaagcaaagctcaatgaaaacctgcgcagaaatattgaaaggattaataatgaaattgatcagttgatgaaccaaatgcaacagatcgagacccagcaaaggaaatttaaagcatctagagatagcatattatcagaaatgaagatgctaaaagagaagaggcagcagtcagagaaaaccttcatgcctaagcaacgtagcttacagagtttggaggcaagcttgcatgctatggagtctaccagagagtcattgaaagcagaactgggaactgatttgctttctcaactgagtttggaagatcagaagagagtagatgcactgaatgatgagattcgtcaacttcagcaggaaaacagacagttgctaaatgaaagaattaaattagaaggtattattactcgagtagagacttatctcaatgagaatctgagaaaacgcttggaccaagtagaacaggaacttaatgagctgagagagacagaagggggtactgttctcacagccacaacatcagaacttgaagccatcaataaaagagtaaaagacactatggcacgatcagaagatttggacaattccattgataaaacagaagctggaattaaggagcttcagaagagtatggagcgctggaaaaatatggaaaaagaacatatggatgctataaatcatgatactaaagaactggaaaagatgacaaatcggcaaggcatgctattgaagaagaaagaagagtgtatgaagaaaattcgagaacttggatcacttccccaggaagcatttgaaaagtaccagacactgagcctcaaacagttgtttcgaaaacttgagcagtgcaacacagaattaaagaagtacagccatgttaacaaaaaggctttggatcagtttgtaaatttctccgagcagaaagaaaagttaataaagcgtcaagaagagttagataggggttacaaatcgatcatggaactgatgaatgtacttgaacttcggaaatatgaagctattcagttaactttcaaacaggtatctaagaacttcagtgaagtattccagaagttagtacctggtggcaaagctactttggtgatgaagaaaggagatgtggagggcagtcagtctcaagatgaaggagaagggagtggtgagagtgagaggggttctggctcacaaagcagtgtcccatcagttgaccagtttactggagttggaattagggtgtcatttacaggaaaacaaggtgaaatgagagaaatgcaacagctttcaggtggacagaaatccttggtagcccttgctctgatttttgccattcagaaatgtgacccggctccattttacttgtttgatgaaattgaccaggctctggatgctcagcacagaaaggctgtgtcagatatgattatggaacttgctgtacatgctcagtttattacaactacttttaggcctgaactgcttgagtcagctgacaaattctatggtgtaaagttcagaaataaggttagtcatattgatgtgatcacagcagagatggccaaagactttgtagaagatgataccacacatggttaattggaaaatactacctactggtttgggagatgtatatagtaatatgattctcatacccaggaactgtaaatttaaacctaaatatttggccaatagttttcagacttaaagcatcatagtccttttatatttgtctttgtattttataagatactctgtaatgtcatgtttgtactgatagtttaagaatttaatttcctgtacaactttttgtaaaatgttctgctcctattttaaatgttttgaaacatgctaaatattctttcctaattattttatcacttatactaccttttttatagcttcaattaaataatcggttttatgacta

SEQ ID NO: 304709 - DNA, 733 bp, Homo sapiens
tggctgaggggagcgagcggcgctttgggggaggggtcgcgtaggcgcctcacctgaccctgcggccgtgcggttgctgctccggggcaggtctccttccaggccaggggcccggaatcatgtacataaagcaggtgattatccagggttttcgaagttacagagatcaaacaattgtagatcccttcagttcaaaacataatgtgattgtgggcagaaatggatctggaaaaagtaactttttttatgcaattcagtttgttctcagtgatgagtttagtcatcttcgtccagaacagcggttggctttattgcatgaaggtactggtcctcgtgttatttctgcttttgtggagattatttttgataattcagacaaccggttaccaatcgataaagaggaagtttcacttcgaagagttattggtgccaaaaaggatcagtatttcttagacaagaagatggtcacgaaaaatgatgtgatgaacctccttgaaagcgctggtttttctcgaagcaatccttattatattgttaaacaaggaaagatcaaccagatggcaacagcaccagattctcagagattaaagctattaagagaagtagctggtactagagtgtatgacgaacgaaaggaagaaagcatctccttaatgaaagaaacagagggcaaacgggaaaaaatcaatgagttgttaaaatacattgaagagagattacatactctagagga

SEQ ID NO: 304710 - DNA, 924 bp, Homo sapiens
cggccgcgggcgggaagggctgtgtggtcctgcaggggtggcctcacacggcccatgtgcctgggatgtgtggaaaggtggcttccccggcccgggggcggccctgggggcattggctggggtgtcgtcacctgtcactgcggggagccgttcctctccccagttaacccgcgaagtgagcgggaccctcctgcttgcaggatacggagcgccgcctccctcggttgtttacttctgtcaaaatggtcttcccgcgcgggactccaccacaaagatgagcccaggcacacggccttggagacggttttctgttgggtgattatccagggttttcgaagttacagagatcaaacaattgtagatcccttcagttcaaaacataatgtgattgtgggcagaaatggatctggaaaaagtaactttttttatgcaattcagtttgttctcagtgatgagtttagtcatcttcgtccagaacagcggttggctttattgcatgaaggtactggtcctcgtgttatttctgcttttgtggagattatttttgataattcagacaaccggttaccaatcgataaagaggaagtttcacttcgaagagttattggtgccaaaaaggatcagtatttcttagacaagaagatggtcacgaaaaatgatgtgatgaacctccttgaaagcgctggtttttctcgaagcaatccttattatattgttaaacaaggaaagatcaaccagatggcaacagcaccagattctcagagattaaagctattaagagaagtagctggtactagagtgtatgacgaacgaaaggaagaaagcatctccttaatgaaagaaacagagggcaaacgggaaaaaatcaatcagctgtcccaatgtcctcaagaaagttatcatatgtcaaaggaaataagacaa

SEQ ID NO: 304711 - DNA, 502 bp, Homo sapiens
cggccgcgggcgggaagggctgtgtggtcctgcaggggtggcctcacacggcccatgtgcctgggatgtgtggaaaggtggcttccccggcccgggggcggccctgggggcattggctggggtgtcgtcacctgtcactgcggggagccgttcctctccccagttaacccgcgaagtgagcgggaccctcctgcttgcaggatacggagcgccgcctccctcggttgtttacttctgtcaaaatggtcttcccgcgcgggactccaccacaaagatgagcccaggcacacggccttggagacggttttctgttgggtctgtcgggctctgagcactccttctttggaacgtgggttctttcaggctggccggcgtgagtgactgaaagcagcactcggtggtcttggagtcaggagagctggggcccgtcggcctgcttttatagacttgctattgtactgcagcgtttagggttcagttaagctcacacagtgtttttgat

SEQ ID NO: 304712 - DNA, 361 bp, Homo sapiens
  misc_feature (1)..(1): n is a, c, g, or t
ngtttggaattagaaggtatttcagtagagtgtaacttagagaatattgccggcgacacttttcagacttaaagcatcatagtccttttatatttgtctttgtattttataagatactctgtaatgtcatgtttgtactgatagtttaagaatttaatttcctgtacaactttttgtaaaatgttctgctcctattttaaatgttttgaaacatgctaaatattctttcctaattattttatcacttatactaccttttttatagcttcaattaaataatcggttttatgactaatatagtgttttatgtggcttttcatttgtcatagtctcttccagtgagaacactaatcagattgga

SEQ ID NO: 304713 - DNA, 4171 bp, Homo sapiens
tggctgaggggagcgagcggcgctttgggggaggggtcgcgtaggcgcctcacctgaccctgcggccgtgcggttgctgctccggggcaggtctccttccaggccaggggcccggaatcatgtacataaagcaggtgattatccagggttttcgaagttacagagatcaaacaattgtagatcccttcagttcaaaacataatgtgattgtgggcagaaatggatctggaaaaagtaactttttttatgcaattcagtttgttctcagtgatgagtttagtcatcttcgtccagaacagcggttggctttattgcatgaaggtactggtcctcgtgttatttctgcttttgtggagattatttttgataattcagacaaccggttaccaatcgataaagaggaagtttcacttcgaagagttattggtgccaaaaaggatcagtatttcttagacaagaagatggtcacgaaaaatgatgtgatgaacctccttgaaagcgctggtttttctcgaagcaatccttattatattgttaaacaaggaaagatcaaccagatggcaacagcaccagattctcagagattaaagctattaagagaagtagctggtactagagtgtatgacgaacgaaaggaagaaagcatctccttaatgaaagaaacagagggcaaacgggaaaaaatcaatgagttgttaaaatacattgaagagagattacatactctagaggaagaaaaggaagaactagctcagtatcagaagtgggataaaatgagacgagccctggaatataccatttacaatcaggaacttaacgagactcgtgccaaacttgatgagctttctgctaagcgagagactagtggagaaaaatccagacaattaagagatgctcagcaggatgcaagagataaaatggaggatatcgaacgccaagttagagaattgaaaacaaaaatttcagctatgaaagaagaaaaagaacagcttagtgctgaaagacaagagcagattaagcagaggactaagttggagcttaaagccaaggatttacaagatgaactagcaggcaatagtgaacaaaggaaacgtttattaaaagagaggcagaagctgcttgaaaaaatagaagaaaagcagaaagaactggcagaaacagaacccaaattcaacagtgtgaaagagaaagaagaacgaggaattgctagattggctcaagctacccaggaaagaacggatctttatgcaaagcagggtcgaggaagccagtttacatcaaaagaagaaagggataagtggattaaaaaggaactcaagtctttagatcaggctattaatgacaagaaaagacagattgctgctatacataaggatttggaagacactgaagcaaataaagagaaaaatctggagcagtataataaactggaccaggatcttaatgaagtcaaagctcgagtagaagaactggacagaaaatattacgaagtaaaaaataagaaagatgaactacaaagtgaaagaaactacttgtggagagaagagaatgcagaacagcaagcacttgctgctaaaagagaagatcttgaaaagaagcaacaacttcttagagcagcaacaggaaaggccattttaaatggaatagacagcataaacaaagtgctagaccacttccgtcgaaaaggaataaaccagcatgttcaaaatggctatcatggtattgtaatgaataactttgaatgtgaaccagctttctacacatgcgtggaagtcactgctggaaacaggttattttatcacattgttgattcagatgaagtcagcacgaagattttaatggagtttaataaaatgaatcttcctggagaggttacttttctgcctcttaacaagttagatgtcagggatacagcctatcctgaaaccaatgatgctattcctatgatcagcaaactgaggtacaatcccagatttgacaaagctttcaaacatgtgtttggaaagactcttatttgtcgtagcatggaagtttcaacccagctggcccgtgctttcactatggactgtattactttggaaggtgaccaagtcagccatcggggtgctctaactgggggttattatgacacaaggaagtctcgacttgaattgcaaaaagatgttagaaaagcagaagaagaactaggtgaacttgaagcaaagctcaatgaaaacctgcgcagaaatattgaaaggattaataatgaaattgatcagttgatgaaccaaatgcaacagatcgagacccagcaaaggaaatttaaagcatctagagatagcatattatcagaaatgaagatgctaaaagagaagaggcagcagtcagagaaaaccttcatgcctaagcaacgtagcttacagagtttggaggcaagcttgcatgctatggagtctaccagagagtcattgaaagcagaactgggaactgatttgctttctcaactgagtttggaagatcagaagagagtagatgcactgaatgatgagattcgtcaacttcagcaggaaaacagacagttgctaaatgaaagaattaaattagaaggtattattactcgagtagagacttatctcaatgagaatctgagaaaacgcttggaccaagtagaacaggaacttaatgagctgagagagacagaagggggtactgttctcacagccacaacatcagaacttgaagccatcaataaaagagtaaaagacactatggcacgatcagaagatttggacaattccattgataaaacagaagctggaattaaggagcttcagaagagtatggagcgctggaaaaatatggaaaaagaacatatggatgctataaatcatgatactaaagaactggaaaagatgacaaatcggcaaggcatgctattgaagaagaaagaagagtgtatgaagaaaattcgagaacttggatcacttccccaggaagcatttgaaaagtaccagacactgagcctcaaacagttgtttcgaaaacttgagcagtgcaacacagaattaaagaagtacagccatgttaacaaaaaggctttggatcagtttgtaaatttctccgagcagaaagaaaagttaataaagcgtcaagaagagttagataggggttacaaatcgatcatggaactgatgaatgtacttgaacttcggaaatatgaagctattcagttaactttcaaacaggtatctaagaacttcagtgaagtattccagaagttagtacctggtggcaaagctactttggtgatgaagaaaggagatgtggagggcagtcagtctcaagatgaaggagaagggagtggtgagagtgagaggggttctggctcacaaagcagtgtcccatcagttgaccagtttactggagttggaattagggtgtcatttacaggaaaacaaggtgaaatgagagaaatgcaacagctttcaggtggacagaaatccttggtagcccttgctctgatttttgccattcagaaatgtgacccggctccattttacttgtttgatgaaattgaccaggctctggatgctcagcacagaaaggctgtgtcagatatgattatggaacttgctgtacatgctcagtttattacaactacttttaggcctgaactgcttgagtcagctgacaaattctatggtgtaaagttcagaaataaggttagtcatattgatgtgatcacagcagagatggccaaagactttgtagaagatgataccacacatggttaattggaaaatactacctactggtttgggagatgtatatagtaatatgattctcatacccaggaactgtaaatttaaacctaaatatttggccaatagttttcagacttaaagcatcatagtccttttatatttgtctttgtattttataagatactctgtaatgtcatgtttgtactgatagtttaagaatttaatttcctgtacaactttttgtaaaatgttctgctcctattttaaatgttttgaaacatgctaaatattctttcctaattattttatcacttatactaccttttttatagcttcaattaaataatcggttttatgactaatatagtgttttatgtggcttttcatttgtcatagtctcttccagtgagaacactaatcagattgga

SEQ ID NO: 304714 - DNA, 3974 bp, Homo sapiens
ctctaactgggggttattatgacacaaggaagtctcgacttgaattgcaaaaagatgttagaaaagcagaagaagaactaggtgaacttgaagcaaagctcaatgaaagaattaaattagaaggtattattactcgagtagagacttatctcaatgagaatctgagaaaacgcttggaccaagtagaacaggaacttaatgagctgagagagacagaagggggtactgttctcacagccacaacatcagaacttgaagccatcaataaaagagtaaaagacactatggcacgatcagaagatttggacaattccattgataaaacagaagctggaattaaggagcttcagaagagtatggagcgctggaaaaatatggaaaaagaacatatggatgctataaatcatgatactaaagaatcaaccagatggcaacagcaccagattctcagagattaaagctattaagagaagtagctggtactagagtgtatgacgaacgaaaggaagaaagcatctccttaatgaaagaaacagagggcaaacgggaaaaaatcaatgagttgttaaaatacattgaagagagattacatactctagaggaagaaaaggaagaactagctcagtatcagaagtgggataaaatgagacgagccctggaatataccatttacaatcaggaacttaacgagactcgtgccaaacttgatgagctttctgctaagcgagagactagtggagaaaaatccagacaattaagagatgctcagcaggatgcaagagataaaatggaggatatcgaacgccaagttagagaattgaaaacaaaaatttcagctatgaaagaagaaaaagaacagcttagtgctgaaagacaagagcagattaagcagaggactaagttggagcttaaagccaaggatttacaagatgaactagcaggcaatagtgaacaaaggaaacgtttattaaaagagaggcagaagctgcttgaaaaaatagaagaaaagcagaaagaactggcagaaacagaacccaaattcaacagtgtgaaagagaaagaagaacgaggaattgctagattggctcaagctacccaggaaagaacggatctttatgcaaagcagggtcgaggaagccagtttacatcaaaagaagaaagggataagtggattaaaaaggaactcaagtctttagatcaggctattaatgacaagaaaagacagattgctgctatacataaggatttggaagacactgaagcaaataaagagaaaaatctggagcagtataataaactggaccaggatcttaatgaagtcaaagctcgagtagaagaactggacagaaaatattacgaagtaaaaaataagaaagatgaactacaaagtgaaagaaactacttgtggagagaagagaatgcagaacagcaagcacttgctgctaaaagagaagatcttgaaaagaagcaacaacttcttagagcagcaacaggaaaggccattttaaatggaatagacagcataaacaaagtgctagaccacttccgtcgaaaaggaataaaccagcatgttcaaaatggctatcatggtattgtaatgaataactttgaatgtgaaccagctttctacacatgcgtggaagtcactgctggaaacaggttattttatcacattgttgattcagatgaagtcagcacgaagattttaatggagtttaataaaatgaatcttcctggagaggttacttttctgcctcttaacaagttagatgtcagggatacagcctatcctgaaaccaatgatgctattcctatgatcagcaaactgaggtacaatcccagatttgacaaagctttcaaacatgtgtttggaaagactcttatttgtcgtagcatggaagtttcaacccagctggcccgtgctttcactatggactgtattactttggaaggtgaccaagtcagccatcggggtgctctaactgggggttattatgacacaaggaagtctcgacttgaattgcaaaaagatgttagaaaagcagaagaagaactaggtgaacttgaagcaaagctcaatgaaaacctgcgcagaaatattgaaaggattaataatgaaattgatcagttgatgaaccaaatgcaacagatcgagacccagcaaaggaaatttaaagcatctagagatagcatattatcagaaatgaagatgctaaaagagaagaggcagcagtcagagaaaaccttcatgcctaagcaacgtagcttacagagtttggaggcaagcttgcatgctatggagtctaccagagagtcattgaaagcagaactgggaactgatttgctttctcaactgagtttggaagatcagaagagagtagatgcactgaatgatgagattcgtcaacttcagcaggaaaacagacagttgctaaatgaaagaattaaattagaaggtattattactcgagtagagacttatctcaatgagaatctgagaaaacgcttggaccaagtagaacaggaacttaatgagctgagagagacagaagggggtactgttctcacagccacaacatcagaacttgaagccatcaataaaagagtaaaagacactatggcacgatcagaagatttggacaattccattgataaaacagaagctggaattaaggagcttcagaagagtatggagcgctggaaaaatatggaaaaagaacatatggatgctataaatcatgatactaaagaactggaaaagatgacaaatcggcaaggcatgctattgaagaagaaagaagagtgtatgaagaaaattcgagaacttggatcacttccccaggaagcatttgaaaagtaccagacactgagcctcaaacagttgtttcgaaaacttgagcagtgcaacacagaattaaagaagtacagccatgttaacaaaaaggctttggatcagtttgtaaatttctccgagcagaaagaaaagttaataaagcgtcaagaagagttagataggggttacaaatcgatcatggaactgatgaatgtacttgaacttcggaaatatgaagctattcagttaactttcaaacaggtatctaagaacttcagtgaagtattccagaagttagtacctggtggcaaagctactttggtgatgaagaaaggagatgtggagggcagtcagtctcaagatgaaggagaagggagtggtgagagtgagaggggttctggctcacaaagcagtgtcccatcagttgaccagtttactggagttggaattagggtgtcatttacaggaaaacaaggtgaaatgagagaaatgcaacagctttcaggtggacagaaatccttggtagcccttgctctgatttttgccattcagaaatgtgacccggctccattttacttgtttgatgaaattgaccaggctctggatgctcagcacagaaaggctgtgtcagatatgattatggaacttgctgtacatgctcagtttattacaactacttttaggcctgaactgcttgagtcagctgacaaattctatggtgtaaagttcagaaataaggttagtcatattgatgtgatcacagcagagatggccaaagactttgtagaagatgataccacacatggttaattggaaaatactacctactggtttgggagatgtatatagtaatatgattctcatacccaggaactgtaaatttaaacctaaatatttggccaatagttttcagacttaaagcatcatagtccttttatatttgtctttgtattttataagatactctgtaatgtcatgtttgtactgatagtttaagaatttaatttcctgtacaactttttgtaaaatgttctgctcctattttaaatgttttgaaacatgctaaatattctttcctaattattttatcacttatactaccttttttatagcttcaattaaataatcggttttatgacta

SEQ ID NO: 304715 - DNA, 4522 bp, Homo sapiens
tggctgaggggagcgagcggcgctttgggggaggggtcgcgtaggcgcctcacctgaccctgcggccgtgcggttgctgctccggggcaggtctccttccaggccaggggcccggaatcatgtacataaagcaggtgattatccagggttttcgaagttacagagatcaaacaattgtagatcccttcagttcaaaacataatgtgattgtgggcagaaatggatctggaaaaagtaactttttttatgcaattcagtttgttctcagtgatgagtttagtcatcttcgtccagaacagcggttggctttattgcatgaaggtactggtcctcgtgttatttctgcttttgtggagattatttttgataattcagacaaccggttaccaatcgataaagaggaagtttcacttcgaagagttattggtgccaaaaaggatcagtatttcttagacaagaagatggtcacgaaaaatgatgtgatgaacctccttgaaagcgctggtttttctcgaagcaatccttattatattgttaaacaaggaaagatcaaccagatggcaacagcaccagattctcagagattaaagctattaagagaagtagctggtactagagtgtatgacgaacgaaaggaagaaagcatctccttaatgaaagaaacagagggcaaacgggaaaaaatcaatgagttgttaaaatacattgaagagagattacatactctagaggaagaaaaggaagaactagctcagtatcagaagtgggataaaatgagacgagccctggaatataccatttacaatcaggaacttaacgagactcgtgccaaacttgatgagctttctgctaagcgagagactagtggagaaaaatccagacaattaagagatgctcagcaggatgcaagagataaaatggaggatatcgaacgccaagttagagaattgaaaacaaaaatttcagctatgaaagaagaaaaagaacagcttagtgctgaaagacaagagcagattaagcagaggactaagttggagcttaaagccaaggatttacaagatgaactagcaggcaatagtgaacaaaggaaacgtttattaaaagagaggcagaagctgcttgaaaaaatagaagaaaagcagaaagaactggcagaaacagaacccaaattcaacagtgtgaaagagaaagaagaacgaggaattgctagattggctcaagctacccaggaaagaacggatctttatgcaaagcagggtcgaggaagccagtttacatcaaaagaagaaagggataagtggattaaaaaggaactcaagtctttagatcaggctattaatgacaagaaaagacagattgctgctatacataaggatttggaagacactgaagcaaataaagagaaaaatctggagcagtataataaactggaccaggatcttaatgaagtcaaagctcgagtagaagaactggacagaaaatattacgaagtaaaaaataagaaagatgaactacaaagtgaaagaaactacttgtggagagaagagaatgcagaacagcaagcacttgctgctaaaagagaagatcttgaaaagaagcaacaacttcttagagcagcaacaggaaaggccattttaaatggaatagacagcataaacaaagtgctagaccacttccgtcgaaaaggaataaaccagcatgttcaaaatggctatcatggtattgtaatgaataactttgaatgtgaaccagctttctacacatgcgtggaagtcactgctggaaacaggttaaagcttttgcttgatatttagcatttttagaagagggaataagaatagcttaaacaacttttgtagtttttgtacaacatatcttccattatctttttatatctcggttccttaactttctaattaaagaagtagatgctaagtatttgttcctaattatagaagctagaactttcctcttttgggagtttctccctccccgccattggaatttttaaagtagtcttattttccaaaattatttggattatataggaaaaaactgtttgatgcttaagtgtttataacattttaaaagtgcacacctttagtcccagctatgcaggaggctgaggtgggaggattgataagtttgggcaacatagggagaccctgagtaccaataaagatttgtcttactctgtttatatttaggttattttatcacattgttgattcagatgaagtcagcacgaagattttaatggagtttaataaaatgaatcttcctggagaggttacttttctgcctcttaacaagttagatgtcagggatacagcctatcctgaaaccaatgatgctattcctatgatcagcaaactgaggtacaatcccagatttgacaaagctttcaaacatgtgtttggaaagactcttatttgtcgtagcatggaagtttcaacccagctggcccgtgctttcactatggactgtattactttggaaggtgaccaagtcagccatcggggtgctctaactgggggttattatgacacaaggaagtctcgacttgaattgcaaaaagatgttagaaaagcagaagaagaactaggtgaacttgaagcaaagctcaatgaaaacctgcgcagaaatattgaaaggattaataatgaaattgatcagttgatgaaccaaatgcaacagatcgagacccagcaaaggaaatttaaagcatctagagatagcatattatcagaaatgaagatgctaaaagagaagaggcagcagtcagagaaaaccttcatgcctaagcaacgtagcttacagagtttggaggcaagcttgcatgctatggagtctaccagagagtcattgaaagcagaactgggaactgatttgctttctcaactgagtttggaagatcagaagagagtagatgcactgaatgatgagattcgtcaacttcagcaggaaaacagacagttgctaaatgaaagaattaaattagaaggtattattactcgagtagagacttatctcaatgagaatctgagaaaacgcttggaccaagtagaacaggaacttaatgagctgagagagacagaagggggtactgttctcacagccacaacatcagaacttgaagccatcaataaaagagtaaaagacactatggcacgatcagaagatttggacaattccattgataaaacagaagctggaattaaggagcttcagaagagtatggagcgctggaaaaatatggaaaaagaacatatggatgctataaatcatgatactaaagaactggaaaagatgacaaatcggcaaggcatgctattgaagaagaaagaagagtgtatgaagaaaattcgagaacttggatcacttccccaggaagcatttgaaaagtaccagacactgagcctcaaacagttgtttcgaaaacttgagcagtgcaacacagaattaaagaagtacagccatgttaacaaaaaggctttggatcagtttgtaaatttctccgagcagaaagaaaagttaataaagcgtcaagaagagttagataggggttacaaatcgatcatggaactgatgaatgtacttgaacttcggaaatatgaagctattcagttaactttcaaacaggtatctaagaacttcagtgaagtattccagaagttagtacctggtggcaaagctactttggtgatgaagaaaggagatgtggagggcagtcagtctcaagatgaaggagaagggagtggtgagagtgagaggggttctggctcacaaagcagtgtcccatcagttgaccagtttactggagttggaattagggtgtcatttacaggaaaacaaggtgaaatgagagaaatgcaacagctttcaggtggacagaaatccttggtagcccttgctctgatttttgccattcagaaatgtgacccggctccattttacttgtttgatgaaattgaccaggctctggatgctcagcacagaaaggctgtgtcagatatgattatggaacttgctgtacatgctcagtttattacaactacttttaggcctgaactgcttgagtcagctgacaaattctatggtgtaaagttcagaaataaggttagtcatattgatgtgatcacagcagagatggccaaagactttgtagaagatgataccacacatggttaattggaaaatactacctactggtttgggagatgtatatagtaatatgattctcatacccaggaactgtaaatttaaacctaaatatttggccaatagttttcagacttaaagcatcatagtccttttatatttgtctttgtattttataagatactctgtaatgtcatgtttgtactgatagtttaagaatttaatttcctgtacaactttttgtaaaatgttctgctcctattttaaatgttttgaaacatgctaaatattctttcctaattattttatcacttatactaccttttttatagcttcaattaaataatcggttttatgacta

SEQ ID NO: 304716 - DNA, 3029 bp, Homo sapiens
ctctaactgggggttattatgacacaaggaagtctcgacttgaattgaaaaaatagaagaaaagcagaaagaactggcagaaacagaacccaaattcaacagtgtgaaagagaaagaagaacgaggaattgctagattggctcaagctacccaggaaagaacggatctttatgcaaagcagggtcgaggaagccagtttacatcaaaagaagaaagggataagtggattaaaaaggaactcaagtctttagatcaggctattaatgacaagaaaagacagattgctgctatacataaggatttggaagacactgaagcaaataaagagaaaaatctggagcagtataataaactggaccaggatcttaatgaagtcaaagctcgagtagaagaactggacagaaaatattacgaagtaaaaaataagaaagatgaactacaaagtgaaagaaactacttgtggagagaagagaatgcagaacagcaagcacttgctgctaaaagagaagatcttgaaaagaagcaacaacttcttagagcagcaacaggaaaggccattttaaatggaatagacagcataaacaaagtgctagaccacttccgtcgaaaaggaataaaccagcatgttcaaaatggctatcatggtattgtaatgaataactttgaatgtgaaccagctttctacacatgcgtggaagtcactgctggaaacaggttattttatcacattgttgattcagatgaagtcagcacgaagattttaatggagtttaataaaatgaatcttcctggagaggttacttttctgcctcttaacaagttagatgtcagggatacagcctatcctgaaaccaatgatgctattcctatgatcagcaaactgaggtacaatcccagatttgacaaagctttcaaacatgtgtttggaaagactcttatttgtcgtagcatggaagtttcaacccagctggcccgtgctttcactatggactgtattactttggaaggtgaccaagtcagccatcggggtgctctaactgggggttattatgacacaaggaagtctcgacttgaattgcaaaaagatgttagaaaagcagaagaagaactaggtgaacttgaagcaaagctcaatgaaaacctgcgcagaaatattgaaaggattaataatgaaattgatcagttgatgaaccaaatgcaacagatcgagacccagcaaaggaaatttaaagcatctagagatagcatattatcagaaatgaagatgctaaaagagaagaggcagcagtcagagaaaaccttcatgcctaagcaacgtagcttacagagtttggaggcaagcttgcatgctatggagtctaccagagagtcattgaaagcagaactgggaactgatttgctttctcaactgagtttggaagatcagaagagagtagatgcactgaatgatgagattcgtcaacttcagcaggaaaacagacagttgctaaatgaaagaattaaattagaaggtattattactcgagtagagacttatctcaatgagaatctgagaaaacgcttggaccaagtagaacaggaacttaatgagctgagagagacagaagggggtactgttctcacagccacaacatcagaacttgaagccatcaataaaagagtaaaagacactatggcacgatcagaagatttggacaattccattgataaaacagaagctggaattaaggagcttcagaagagtatggagcgctggaaaaatatggaaaaagaacatatggatgctataaatcatgatactaaagaactggaaaagatgacaaatcggcaaggcatgctattgaagaagaaagaagagtgtatgaagaaaattcgagaacttggatcacttccccaggaagcatttgaaaagtaccagacactgagcctcaaacagttgtttcgaaaacttgagcagtgcaacacagaattaaagaagtacagccatgttaacaaaaaggctttggatcagtttgtaaatttctccgagcagaaagaaaagttaataaagcgtcaagaagagttagataggggttacaaatcgatcatggaactgatgaatgtacttgaacttcggaaatatgaagctattcagttaactttcaaacaggtatctaagaacttcagtgaagtattccagaagttagtacctggtggcaaagctactttggtgatgaagaaaggagatgtggagggcagtcagtctcaagatgaaggagaagggagtggtgagagtgagaggggttctggctcacaaagcagtgtcccatcagttgaccagtttactggagttggaattagggtgtcatttacaggaaaacaaggtgaaatgagagaaatgcaacagctttcaggtggacagaaatccttggtagcccttgctctgatttttgccattcagaaatgtgacccggctccattttacttgtttgatgaaattgaccaggctctggatgctcagcacagaaaggctgtgtcagatatgattatggaacttgctgtacatgctcagtttattacaactacttttaggcctgaactgcttgagtcagctgacaaattctatggtgtaaagttcagaaataaggttagtcatattgatgtgatcacagcagagatggccaaagactttgtagaagatgataccacacatggttaattggaaaatactacctactggtttgggagatgtatatagtaatatgattctcatacccaggaactgtaaatttaaacctaaatatttggccaatagttttcagacttaaagcatcatagtccttttatatttgtctttgtattttataagatactctgtaatgtcatgtttgtactgatagtttaagaatttaatttcctgtacaactttttgtaaaatgttctgctcctattttaaatgttttgaaacatgctaaatattctttcctaattattttatcacttatactaccttttttatagcttcaattaaataatcggttttatgacta

SEQ ID NO: 304717 - DNA, 3031 bp, Homo sapiens
gatcttaatgaagtcaaagctcgagtagaagaactggacagaaaatattacgaagtaaaaaataagaaagatgaactggcagaaacagaacccaaattcaacagtgtgaaagagaaagaagaacgaggaattgctagattggctcaagctacccaggaaagaacggatctttatgcaaagcagggtcgaggaagccagtttacatcaaaagaagaaagggataagtggattaaaaaggaactcaagtctttagatcaggctattaatgacaagaaaagacagattgctgctatacataaggatttggaagacactgaagcaaataaagagaaaaatctggagcagtataataaactggaccaggatcttaatgaagtcaaagctcgagtagaagaactggacagaaaatattacgaagtaaaaaataagaaagatgaactacaaagtgaaagaaactacttgtggagagaagagaatgcagaacagcaagcacttgctgctaaaagagaagatcttgaaaagaagcaacaacttcttagagcagcaacaggaaaggccattttaaatggaatagacagcataaacaaagtgctagaccacttccgtcgaaaaggaataaaccagcatgttcaaaatggctatcatggtattgtaatgaataactttgaatgtgaaccagctttctacacatgcgtggaagtcactgctggaaacaggttattttatcacattgttgattcagatgaagtcagcacgaagattttaatggagtttaataaaatgaatcttcctggagaggttacttttctgcctcttaacaagttagatgtcagggatacagcctatcctgaaaccaatgatgctattcctatgatcagcaaactgaggtacaatcccagatttgacaaagctttcaaacatgtgtttggaaagactcttatttgtcgtagcatggaagtttcaacccagctggcccgtgctttcactatggactgtattactttggaaggtgaccaagtcagccatcggggtgctctaactgggggttattatgacacaaggaagtctcgacttgaattgcaaaaagatgttagaaaagcagaagaagaactaggtgaacttgaagcaaagctcaatgaaaacctgcgcagaaatattgaaaggattaataatgaaattgatcagttgatgaaccaaatgcaacagatcgagacccagcaaaggaaatttaaagcatctagagatagcatattatcagaaatgaagatgctaaaagagaagaggcagcagtcagagaaaaccttcatgcctaagcaacgtagcttacagagtttggaggcaagcttgcatgctatggagtctaccagagagtcattgaaagcagaactgggaactgatttgctttctcaactgagtttggaagatcagaagagagtagatgcactgaatgatgagattcgtcaacttcagcaggaaaacagacagttgctaaatgaaagaattaaattagaaggtattattactcgagtagagacttatctcaatgagaatctgagaaaacgcttggaccaagtagaacaggaacttaatgagctgagagagacagaagggggtactgttctcacagccacaacatcagaacttgaagccatcaataaaagagtaaaagacactatggcacgatcagaagatttggacaattccattgataaaacagaagctggaattaaggagcttcagaagagtatggagcgctggaaaaatatggaaaaagaacatatggatgctataaatcatgatactaaagaactggaaaagatgacaaatcggcaaggcatgctattgaagaagaaagaagagtgtatgaagaaaattcgagaacttggatcacttccccaggaagcatttgaaaagtaccagacactgagcctcaaacagttgtttcgaaaacttgagcagtgcaacacagaattaaagaagtacagccatgttaacaaaaaggctttggatcagtttgtaaatttctccgagcagaaagaaaagttaataaagcgtcaagaagagttagataggggttacaaatcgatcatggaactgatgaatgtacttgaacttcggaaatatgaagctattcagttaactttcaaacaggtatctaagaacttcagtgaagtattccagaagttagtacctggtggcaaagctactttggtgatgaagaaaggagatgtggagggcagtcagtctcaagatgaaggagaagggagtggtgagagtgagaggggttctggctcacaaagcagtgtcccatcagttgaccagtttactggagttggaattagggtgtcatttacaggaaaacaaggtgaaatgagagaaatgcaacagctttcaggtggacagaaatccttggtagcccttgctctgatttttgccattcagaaatgtgacccggctccattttacttgtttgatgaaattgaccaggctctggatgctcagcacagaaaggctgtgtcagatatgattatggaacttgctgtacatgctcagtttattacaactacttttaggcctgaactgcttgagtcagctgacaaattctatggtgtaaagttcagaaataaggttagtcatattgatgtgatcacagcagagatggccaaagactttgtagaagatgataccacacatggttaattggaaaatactacctactggtttgggagatgtatatagtaatatgattctcatacccaggaactgtaaatttaaacctaaatatttggccaatagttttcagacttaaagcatcatagtccttttatatttgtctttgtattttataagatactctgtaatgtcatgtttgtactgatagtttaagaatttaatttcctgtacaactttttgtaaaatgttctgctcctattttaaatgttttgaaacatgctaaatattctttcctaattattttatcacttatactaccttttttatagcttcaattaaataatcggttttatgacta

SEQ ID NO: 304718 - DNA, 2831 bp, Homo sapiens
tggctgaggggagcgagcggcgctttgggggaggggtcgcgtaggcgcctcacctgaccctgcggccgtgcggttgctgctccggggcaggtctccttccaggccaggggcccggaatcatgtacataaagcaggtgattatccagggttttcgaagttacagagatcaaacaattgtagatcccttcagttcaaaacataatgtgattgtgggcagaaatggatctggaaaaagtaactttttttatgcaattcagtttgttctcagtgatgagtttagtcatcttcgtccagaacagcggttggctttattgcatgaaggtactggtcctcgtgttatttctgcttttgtggagattatttttgataattcagacaaccggttaccaatcgataaagaggaagtttcacttcgaagagttattggtgccaaaaaggatcagtatttcttagacaagaagatggtcacgaaaaatgatgtgatgaacctccttgaaagcgctggtttttctcgaagcaatccttattatattgttaaacaaggaaagatcaaccagatggcaacagcaccagattctcagagattaaagctattaagagaagtagctggtactagagtgtatgacgaacgaaaggaagaaagcatctccttaatgaaagaaacagagggcaaacgggaaaaaatcaatgagttgttaaaatacattgaagagagattacatactctagaggaagaaaaggaagaactagctcagtatcagaagtgggataaaatgagacgagccctggaatataccatttacaatcaggaacttaacgagactcgtgccaaacttgatgagctttctgctaagcgagagactagtggagaaaaatccagacaattaagagatgctcagcaggatgcaagagataaaatggaggatatcgaacgccaagttagagaattgaaaacaaaaatttcagctatgaaagaagaaaaagaacagcttagtgctgaaagacaagagcagattaagcagaggactaagttggagcttaaagccaaggatttacaagatgaactagcaggcaatagtgaacaaaggaaacgtttattaaaagagaggcagaagctgcttgaaaaaatagaagaaaagcagaaagaactggcagaaacagaacccaaattcaacagtgtgaaagagaaagaagaacgaggaattgctagattggctcaagctacccaggaaagaacggatctttatgcaaagcagggtcgaggaagccagtttacatcaaaagaagaaagggataagtggattaaaaaggaactcaagtctttagatcaggctattaatgacaagaaaagacagattgctgctatacataaggatttggaagacactgaagcaaataaagagaaaaatctggagcagtataataaactggaccaggatcttaatgaagtcaaagctcgagtagaagaactggacagaaaatattacgaagtaaaaaataagaaagatgaactacaaagtgaaagaaactacttgtggagagaagagaatgcagaacagcaagcacttgctgctaaaagagaagatcttgaaaagaagcaacaacttcttagagcagcaacaggaaaggccattttaaatggaatagacagcataaacaaagtgctagaccacttccgtcgaaaaggaataaaccagcatgttcaaaatggctatcatggtattgtaatgaataactttgaatgtgaaccagctttctacacatgcgtggaagtcactgctggaaacaggttattttatcacattgttgattcagatgaagtcagcacgaagattttaatggagtttaataaaatgaatcttcctggagaggttacttttctgcctcttaacaagttagatgtcagggatacagcctatcctgaaaccaatgatgctattcctatgatcagcaaactgaggtacaatcccagatttgacaaagctttcaaacatgtgtttggaaagactcttatttgtcgtagcatggaagtttcaacccagctggcccgtgctttcactatggactgtattactttggaaggtgaccaagtcagccatcggggtgctctaactgggggttattatgacacaaggaagtctcgacttgaattgcaaaaagatgttagaaaagcagaagaagaactaggtgaacttgaagcaaagctcaatgaaaacctgcgcagaaatattgaaaggattaataatgaaattgatcagttgatgaaccaaatgcaacagatcgagacccagcaaaggaaatttaaagcatctagagatagcatattatcagaaatgaagatgctaaaagagaagaggcagcagtcagagaaaaccttcatgcctaagcaacgtagcttacagagtttggaggcaagcttgcatgctatggagtctaccagagagtcattgaaagcagaactgggaactgatttgctttctcaactgagtttggaagatcagaagagagtagatgcactgaatgatgagattcgtcaacttcagcaggaaaacagacagttgctaaatgaaagaattaaattagaaggtattattactcgagtagagacttatctcaatgagaatctgagaaaacgcttggaccaagtagaacaggaacttaatgagctgagagagacagaagggggtactgttctcacagccacaacatcagaacttgaagccatcaataaaagagtaaaagacactatggcacgatcagaagatttggacaattccattgataaaacagaagctggaattaaggagcttcagaagagtatggagcgctgg

SEQ ID NO: 304719 - DNA, 2615 bp, Homo sapiens
tggctgaggggagcgagcggcgctttgggggaggggtcgcgtaggcgcctcacctgaccctgcggccgtgcggttgctgctccggggcaggtctccttccaggccaggggcccggaatcatgtacataaagcaggtgattatccagggttttcgaagttacagagatcaaacaattgtagatcccttcagttcaaaacataatgtgattgtgggcagaaatggatctggaaaaagtaactttttttatgcaattcagtttgttctcagtgatgagtttagtcatcttcgtccagaacagcggttggctttattgcatgaaggtactggtcctcgtgttatttctgcttttgtggagattatttttgataattcagacaaccggttaccaatcgataaagaggaagtttcacttcgaagagttattggtgccaaaaaggatcagtatttcttagacaagaagatggtcacgaaaaatgatgtgatgaacctccttgaaagcgctggtttttctcgaagcaatccttattatattgttaaacaaggaaagatcaaccagatggcaacagcaccagattctcagagattaaagctattaagagaagtagctggtactagagtgtatgacgaacgaaaggaagaaagcatctccttaatgaaagaaacagagggcaaacgggaaaaaatcaatgagttgttaaaatacattgaagagagattacatactctagaggaagaaaaggaagaactagctcagtatcagaagtgggataaaatgagacgagccctggaatataccatttacaatcaggaacttaacgagactcgtgccaaacttgatgagctttctgctaagcgagagactagtggagaaaaatccagacaattaagagatgctcagcaggatgcaagagataaaatggaggatatcgaacgccaagttagagaattgaaaacaaaaatttcagctatgaaagaagaaaaagaacagcttagtgctgaaagacaagagcagattaagcagaggactaagttggagcttaaagccaaggatttacaagatgaactagcaggcaatagtgaacaaaggaaacgtttattaaaagagaggcagaagctgcttgaaaaaatagaagaaaagcagaaagaactggcagaaacagaacccaaattcaacagtgtgaaagagaaagaagaacgaggaattgctagattggctcaagctacccaggaaagaacggatctttatgcaaagcagggtcgaggaagccagtttacatcaaaagaagaaagggataagtggattaaaaaggaactcaagtctttagatcaggctattaatgacaagaaaagacagattgctgctatacataaggatttggaagacactgaagcaaataaagagaaaaatctggagcagtataataaactggaccaggatcttaatgaagtcaaagctcgagtagaagaactggacagaaaatattacgaagtaaaaaataagaaagatgaactacaaagtgaaagaaactacttgtggagagaagagaatgcagaacagcaagcacttgctgctaaaagagaagatcttgaaaagaagcaacaacttcttagagcagcaacaggaaaggccattttaaatggaatagacagcataaacaaagtgctagaccacttccgtcgaaaaggaataaaccagcatgttcaaaatggctatcatggtattgtaatgaataactttgaatgtgaaccagctttctacacatgcgtggaagtcactgctggaaacaggttaaagcttttgcttgatatttagcatttttagaagagggaataagaatagcttaaacaacttttgtagtttttgtacaacatatcttccattatctttttatatctcggttccttaactttctaattaaagaagtagatgctaagtatttgttcctaattatagaagctagaactttcctcttttgggagtttctccctccccgccattggaatttttaaagtagtcttattttccaaaattatttggattatataggaaaaaactgtttgatgcttaagtgtttataacattttaaaagtgcacacctttagtcccagctatgcaggaggctgaggtgggaggattgataagtttgggcaacatagggagaccctgagtaccaataaagatttgtcttactctgtttatatttaggttattttatcacattgttgattcagatgaagtcagcacgaagattttaatggagtttaataaaatgaatcttcctggagaggttacttttctgcctcttaacaagttagatgtcagggatacagcctatcctgaaaccaatgtgagtcattgtgtgataaggtgtatttctcttttataatgttattttttatcacataatctaacacatgctagtgcccaggcactatacactgggattcagtggtgtatgagataaaaatatctgtcttcccatggaccttagtgctgagtgggttttggggagggagacagaagtcacagctatgattggtgtggtgatgcacgcctgtaatcccagctacttgggaggctgaagtgggaggatcatttaaaaagaagagaaaa

SEQ ID NO: 304720 - DNA, 1582 bp, Homo sapiens
gctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatggccccaggcagcaatgtgctattgaaacttctaaaactaggcctagttttagaagtttcaatagcacgatcagaagatttggacaattccattgataaaacagaagctggaattaaggagcttcagaagagtatggagcgctggaaaaatatggaaaaagaacatatggatgctataaatcatgatactaaagaactggaaaagatgacaaatcggcaaggcatgctattgaagaagaaagaagagtgtatgaagaaaattcgagaacttggatcacttccccaggaagcatttgaaaagtaccagacactgagcctcaaacagttgtttcgaaaacttgagcagtgcaacacagaattaaagaagtacagccatgttaacaaaaaggctttggatcagtttgtaaatttctccgagcagaaagaaaagttaataaagcgtcaagaagagttagataggggttacaaatcgatcatggaactgatgaatgtacttgaacttcggaaatatgaagctattcagttaactttcaaacaggtatctaagaacttcagtgaagtattccagaagttagtacctggtggcaaagctactttggtgatgaagaaaggagatgtggagggcagtcagtctcaagatgaaggagaagggagtggtgagagtgagaggggttctggctcacaaagcagtgtcccatcagttgaccagtttactggagttggaattagggtgtcatttacaggaaaacaaggtgaaatgagagaaatgcaacagctttcaggtggacagaaatccttggtagcccttgctctgatttttgccattcagaaatgtgacccggctccattttacttgtttgatgaaattgaccaggctctggatgctcagcacagaaaggctgtgtcagatatgattatggaacttgctgtacatgctcagtttattacaactacttttaggcctgaactgcttgagtcagctgacaaattctatggtgtaaagttcagaaataaggttagtcatattgatgtgatcacagcagagatggccaaagactttgtagaagatgataccacacatggttaattggaaaatactacctactggtttgggagatgtatatagtaatatgattctcatacccaggaactgtaaatttaaacctaaatatttggccaatagttttcagacttaaagcatcatagtccttttatatttgtctttgtattttataagatactctgtaatgtcatgtttgtactgatagtttaagaatttaatttcctgtacaactttttgtaaaatgttctgctcctattttaaatgttttgaaacatgctaaatattctttcctaattattttatcacttatactaccttttttatagcttcaattaaataatcggttttatgacta

SEQ ID NO: 304721 - DNA, 743 bp, Homo sapiens
tggctgaggggagcgagcggcgctttgggggaggggtcgcgtaggcgcctcacctgaccctgcggccgtgcggttgctgctccggggcaggtctccttccaggccaggggcccggaatcatgtacataaagcaggtgattatccagggttttcgaagttacagagatcaaacaattgtagatcccttcagttcaaaacataatgtgattgtgggcagaaatggatctggaaaaagtaactttttttatgcaattcagtttgttctcagtgatgagtttagtcatcttcgtccagaacagcggttggctttattgcatgaaggtactggtcctcgtgttatttctgcttttgtggagattatttttgataattcagacaaccggttaccaatcgataaagaggaagtttcacttcgaagagttattggtgccaaaaaggatcagtatttcttagacaagaagatggtcacgaaaaatgatgtgatgaacctccttgaaagcgctggtttttctcgaagcaatccttattatattgttaaacaaggaaagatcaaccagatggcaacagcaccagattctcagagattaaagctattaagagaagtagctggtactagagtgtatgacgaacgaaaggaagaaagcatctccttaatgaaagaaacagagggcaaacgggaaaaaatcaatcagctgtcccaatgtcctcaagaaagttatcatatgtcaaaggaaataagacaa

SEQ ID NO: 304722 - DNA, 342 bp, Homo sapiens
tttatcttactgcctttacatatttaatgttttgatcaagcattttaattgatttttaaaactgcatagatgtaaactaccaacaccgattctaaaaaatgaaaagcatttaaagaaactgtttttgacagcatgcgttataaaaagggccagccacaaaaatttaacattatgaattgataagagaaaaatgaagaaagtatagggcttttttgaagaatataacatattaaacttcatttcagctcacatgagcacaagtactagagaggacagcaaatgagcaccattcctgtgtgtgaaatgtacatgcttatatagacaactttttcttaattctag

SEQ ID NO: 304723 - DNA, 365 bp, Homo sapiens
atattctactgctcaaggtcattgccaaggtctgatttttcacagaaaaaaatttgcaacctctggcataaatgggttaattgctattttagtattttaaattgggttaccacatcacatcaaagaaataatgctacagttcttaaaaataatttaattcaaggtatatttaagaagtgatattacataaaaatcttattcaattcttccacctctctccccatttcttttaagagggcaaacgggaaaaaatcaatgagttgttaaaatacattgaagagagattacatactctagaggaagaaaaggaagaactagctcagtatcagaagtgggataaaatgagacgagccctggaatatacc

SEQ ID NO: 304724 - DNA, 183 bp, Homo sapiens
  misc_feature (20)..(20): n is a, c, g, or t
attcgcggccgcgtcgacgnttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtct

SEQ ID NO: 304725 - DNA, 2393 bp, Homo sapiens
  misc_feature (435)..(435): n is a, c, g, or t
tagcactgggttaagagtctctccagacttgtcactgcaagtcacgtaccttttctaggactaagtttcttcactggaagatgaggaggttgcactagatgacctagaaattcccttccagctttaaattccctcttgtgtcacttgctggacttgttctactggacctggcgctcccctgctcctcccttagctgctacgtccgcatcccgcaccagagggcgccacaggctggcccggggcagcgtgcggtgggcggagaggcagaattaggggagtctccaggaggcgtggtgattggccgccgccgggcggaagggggcgtggggagggaaaggccgagcagcgcggtgacgtctcgctggcgggggcggggccgggccgcggagcgtgtgacgctgcggccgccgcggacctggggattaatgggcacanagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgaggctgatgggaaccatcctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaatgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggaggtgagtgagagtggggcaggtgggctggcctggcacacccagtcgtcctgggggttggccctcactgcagggcactgtgcctgagctctgacagtgtggggaagtgtccctgtgatcttggcagtggaacatgcaaggcactgactgagcatgcaggatcagctccatctcattatgtacgtagatagaggtggagacaggaaaaagactaagccagacgtggtggctcacacctgtaatcccagcactttggcaggccgaggcgggtggatcacttgaggtcaggagttcgaaaccagcctggccaacatggtgaaaccccgtctctactaaaaatacaaaaaattagccagatgtggtggcacgcgcctgtaatcccagctacttgggaggctgagccaggagaatcgcttgaacccgagaggtggaggttgcagtgagccaaaatcccaccactgcactccagcctgggtgacagagtgagaccctgtctcaaaaaaaaggaaaaggactaacaggcagtatgctgtcatgttaatgtggggtggaaaaattgtctgcattttttctgcatttttaaaattccaacacaataaatacaataataactatgctaactaa

SEQ ID NO: 304726 - DNA, 731 bp, Homo sapiens
  misc_feature (435)..(435): n is a, c, g, or t
tagcactgggttaagagtctctccagacttgtcactgcaagtcacgtaccttttctaggactaagtttcttcactggaagatgaggaggttgcactagatgacctagaaattcccttccagctttaaattccctcttgtgtcacttgctggacttgttctactggacctggcgctcccctgctcctcccttagctgctacgtccgcatcccgcaccagagggcgccacaggctggcccggggcagcgtgcggtgggcggagaggcagaattaggggagtctccaggaggcgtggtgattggccgccgccgggcggaagggggcgtggggagggaaaggccgagcagcgcggtgacgtctcgctggcgggggcggggccgggccgcggagcgtgtgacgctgcggccgccgcggacctggggattaatgggcacanagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgagtgcagttccccctgcttttttgtttttgtggtttttgagacaaagtctccttctgttgcccagactagagtgcagtggcacagtctcagctcactgcaacctctgcctcctgggttcaagtgattctcctgcctcagc

SEQ ID NO: 304727 - DNA, 408 bp, Homo sapiens
ctcttcagcctgtgcactatgcctggctcctggcgtggctctttgcgtggctcttcgcgtggcaccttgcgtggctcgttgcgtggcccctcgtgtggcacttggcgtggctcttcgcgtggctcttggtgtggctcttcgggtggctctttgcgtggcgcattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaaagggcctcacaaggagccacccaatgtgccgggatcctctagaacagcacca

SEQ ID NO: 304728 - DNA, 3770 bp, Homo sapiens
  misc_feature (435)..(435): n is a, c, g, or t
tagcactgggttaagagtctctccagacttgtcactgcaagtcacgtaccttttctaggactaagtttcttcactggaagatgaggaggttgcactagatgacctagaaattcccttccagctttaaattccctcttgtgtcacttgctggacttgttctactggacctggcgctcccctgctcctcccttagctgctacgtccgcatcccgcaccagagggcgccacaggctggcccggggcagcgtgcggtgggcggagaggcagaattaggggagtctccaggaggcgtggtgattggccgccgccgggcggaagggggcgtggggagggaaaggccgagcagcgcggtgacgtctcgctggcgggggcggggccgggccgcggagcgtgtgacgctgcggccgccgcggacctggggattaatgggcacanagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgagggtctggaatggtctggagtggtctggaaagcagggtcagatacccctggaaaactgaagcccgtggagcaatgatctctacaggactgcttcaaggctgatgggaaccatcctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaatgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccactctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgcccccacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaagc

SEQ ID NO: 304729 - DNA, 3907 bp, Homo sapiens
  misc_feature (435)..(435): n is a, c, g, or t
tagcactgggttaagagtctctccagacttgtcactgcaagtcacgtaccttttctaggactaagtttcttcactggaagatgaggaggttgcactagatgacctagaaattcccttccagctttaaattccctcttgtgtcacttgctggacttgttctactggacctggcgctcccctgctcctcccttagctgctacgtccgcatcccgcaccagagggcgccacaggctggcccggggcagcgtgcggtgggcggagaggcagaattaggggagtctccaggaggcgtggtgattggccgccgccgggcggaagggggcgtggggagggaaaggccgagcagcgcggtgacgtctcgctggcgggggcggggccgggccgcggagcgtgtgacgctgcggccgccgcggacctggggattaatgggcacanagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgagggtctggaatggtctggagtggtctggaaagcagggtcagatacccctggaaaactgaagcccgtggagcaatgatctctacaggactgcttcaaggctgatgggaaccatcctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaatgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccactctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccatcggcgggccgcggcggtgcggagcacaaggagcgcagccagagtgagggacgcggaaagaaggagaagacgcacgaaccgccaacgacagaacaagcaacaaacacaggcacaatcgtctaatgaccgtcagcccacgagaaggccaaaacgacctcaaaagacgcaacaccagaagtcactaagagatcacggagcaaaaacgaagaactgacacgcacaaccaaccacaacaaaaaagagtcgcgaaacccaactcaatcacactcaacaaaaaagaaacaacaaaacaaaacacccaaaaaaaacaacaaaaacaacacaagacaaaccaagcacaacacacacaa

SEQ ID NO: 304730 - DNA, 4134 bp, Homo sapiens
  misc_feature (435)..(435): n is a, c, g, or t
tagcactgggttaagagtctctccagacttgtcactgcaagtcacgtaccttttctaggactaagtttcttcactggaagatgaggaggttgcactagatgacctagaaattcccttccagctttaaattccctcttgtgtcacttgctggacttgttctactggacctggcgctcccctgctcctcccttagctgctacgtccgcatcccgcaccagagggcgccacaggctggcccggggcagcgtgcggtgggcggagaggcagaattaggggagtctccaggaggcgtggtgattggccgccgccgggcggaagggggcgtggggagggaaaggccgagcagcgcggtgacgtctcgctggcgggggcggggccgggccgcggagcgtgtgacgctgcggccgccgcggacctggggattaatgggcacanagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgaggctgatgggaaccatcctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaatgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgcccccacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaagc

SEQ ID NO: 304731 - DNA, 4652 bp, Homo sapiens
gatgtcagatgatctacccgcctcagcctcccagagtgctgggattacagatgtgagccactgtgcccagccgggaacaaatatttttaagtgccaactatgtgccaggcacttgggaaatgataatagtaaaaagacagatccaatctctgcctcatgggtctgtggtttgctggtatatatgagagctggccataacacacagaattgtttcttccatctctgcgaggggtaggaggttctcaccaagagtctgaacaatgctctgggttcccattgctgtttccatgttctcaggatgcctggcaggttttataaactctcagaagtggagctccagggaatacaatgttcattgtcctatttggaaggctgggttgttgtgggtccctgctgggggccggggaaacgtgggcctcctgcctgatttgttttaatctctgaagttcagtggttccagtagctgtttgtgggcttcacttccccttctctgcctttaacaccctgcaggttttcctgttgtcagacagggtggtgagtccctgtgtctctctgtctgtgggggtcaggttgtttgtagatctttcaggaaggtcctgggtggggggccctcctgctttcaaacccataccaagtgctttcctctgaagggaatgtgagggaggaagaaggggggagtttcagagacttctgaggttccccaagagggaagaggtcaaagtacctcctgagcggggagagctactgagttgaactgatttgctttgccatttgctttagcagcagccaggcccagtggcagcaattgtacgtgcatttccaggggtcagttgtccagttcatccctgagccttgagctcccagtcgcagcatctccctcagtcacccaggctggagtgcagtggtgcagtcatagctcacttgcagcctccaacttctgggctcaagtaatcctcctgcctcagcgtccagagtagctaggactacaggaccagttcagattcaaggagaggactacacaagggtgtgaatactaagaggcgtgattcactgaggagagaaacaggcctccttggagaccagctactacttttcagcatccttatgtgaggctgatgggaaccatcctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaatgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgcccccacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaagc

SEQ ID NO: 304732 - DNA, 4050 bp, Homo sapiens
  misc_feature (435)..(435): n is a, c, g, or t
tagcactgggttaagagtctctccagacttgtcactgcaagtcacgtaccttttctaggactaagtttcttcactggaagatgaggaggttgcactagatgacctagaaattcccttccagctttaaattccctcttgtgtcacttgctggacttgttctactggacctggcgctcccctgctcctcccttagctgctacgtccgcatcccgcaccagagggcgccacaggctggcccggggcagcgtgcggtgggcggagaggcagaattaggggagtctccaggaggcgtggtgattggccgccgccgggcggaagggggcgtggggagggaaaggccgagcagcgcggtgacgtctcgctggcgggggcggggccgggccgcggagcgtgtgacgctgcggccgccgcggacctggggattaatgggcacanagttttggcaggagcgggagaattctgcggagcctgcgggacggcggcggtggcgccgtaggcagccgggacaggctgatgggaaccatcctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaatgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgcccccacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaagc

SEQ ID NO: 304733 - DNA, 4162 bp, Homo sapiens
  misc_feature (435)..(435): n is a, c, g, or t
tagcactgggttaagagtctctccagacttgtcactgcaagtcacgtaccttttctaggactaagtttcttcactggaagatgaggaggttgcactagatgacctagaaattcccttccagctttaaattccctcttgtgtcacttgctggacttgttctactggacctggcgctcccctgctcctcccttagctgctacgtccgcatcccgcaccagagggcgccacaggctggcccggggcagcgtgcggtgggcggagaggcagaattaggggagtctccaggaggcgtggtgattggccgccgccgggcggaagggggcgtggggagggaaaggccgagcagcgcggtgacgtctcgctggcgggggcggggccgggccgcggagcgtgtgacgctgcggccgccgcggacctggggattaatgggcacanagttttggcaggagcgggagaattctgcggagcctgcgggacggcggcggtggcgccgtaggcagccgggacaggtcagtccgagacgagagaagcggtcagtgttgtacagtgttttgggcatgcacgtgatactcacacagtggcttctgctcaccaacagatgaagacagatgcaccaacgaggctgatgggaaccatcctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaatgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgcccccacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaagc

SEQ ID NO: 304734 - DNA, 3478 bp, Homo sapiens
gatcgtgccactgcactccagcctgggagacagagcgagactctgtctcaaaaaaaaaaaaagaaaagaaaaagaaaagtgaaggagtctgccccaagtcacaaagctagtaaactgctgagctggaactcaagcccaggcctttgtcaccaaagtctgtcttaccccagctagcgtagctcagtcactcagtaagttagagtccttgtgtgctgggcactgtgaacaaaacagacaaaatcactgctcttgcaaagatacaccaaaaaaaaaaaaaaatcacatcttgtggagcttgcgatctggaggggccaccccatcattcctaccttgctgactctagagcttctgggggccttaggctccaaaaggatttggcccatgcacctgtaaagggatggggatgtcagaggtgctggggcctgcctgggctccttgctgactgcccccttccctgtgcagctatccgttttggtcggatgccggaggctgagaagaggaagctggtggcagggctgactgcaaatgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgcccccacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaagc

SEQ ID NO: 304735 - DNA, 1802 bp, Homo sapiens
  misc_feature (435)..(435): n is a, c, g, or t
tagcactgggttaagagtctctccagacttgtcactgcaagtcacgtaccttttctaggactaagtttcttcactggaagatgaggaggttgcactagatgacctagaaattcccttccagctttaaattccctcttgtgtcacttgctggacttgttctactggacctggcgctcccctgctcctcccttagctgctacgtccgcatcccgcaccagagggcgccacaggctggcccggggcagcgtgcggtgggcggagaggcagaattaggggagtctccaggaggcgtggtgattggccgccgccgggcggaagggggcgtggggagggaaaggccgagcagcgcggtgacgtctcgctggcgggggcggggccgggccgcggagcgtgtgacgctgcggccgccgcggacctggggattaatgggcacanagttttggcaggagcgggagaattctgcggagcctgcgggacggcggcggtggcgccgtaggcagccgggacaggtcagtccgagacgagagaagcggtcagtgttgtacagtgttttgggcatgcacgtgatactcacacagtggcttctgctcaccaacagatgaagacagatgcaccaacgaggggtaggaggttctcaccaagagtctgaacaatgctctgggttcccattgctgtttccatgttctcaggatgcctggcaggttttcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgcccccacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaagc

SEQ ID NO: 304736 - DNA, 1261 bp, Homo sapiens
cagagtccaaacagtgctcagagtccaaacagtgcccagagtccaaacagtgctcagagtccaaacagtgcccagagtccaaacagtgcctttgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgcccccacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaagc

SEQ ID NO: 304737 - DNA, 2569 bp, Homo sapiens
  misc_feature (435)..(435): n is a, c, g, or t
tagcactgggttaagagtctctccagacttgtcactgcaagtcacgtaccttttctaggactaagtttcttcactggaagatgaggaggttgcactagatgacctagaaattcccttccagctttaaattccctcttgtgtcacttgctggacttgttctactggacctggcgctcccctgctcctcccttagctgctacgtccgcatcccgcaccagagggcgccacaggctggcccggggcagcgtgcggtgggcggagaggcagaattaggggagtctccaggaggcgtggtgattggccgccgccgggcggaagggggcgtggggagggaaaggccgagcagcgcggtgacgtctcgctggcgggggcggggccgggccgcggagcgtgtgacgctgcggccgccgcggacctggggattaatgggcacanagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgaggctgatgggaaccatcctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaatgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggaggtgagtgagagtggggcaggtgggctggcctggcacacccagtcgtcctgggggttggccctcactgcagggcactgtgcctgagctctgacagtgtggggaagtgtccctgtgatcttggcagtggaacatgcaaggcactgactgagcatgcaggatcagctccatctcattatgtacgtagatagaggtggagacaggaaaaagactaagccagacgtggtggctcacacctgtaatcccagcactttggcaggccgaggcgggtggatcacttgaggtcaggagttcgaaaccagcctggccaacatggtgaaaccccgtctctactaaaaatacaaaaaattagccagatgtggtggcacgcgcctgtaatcccagctacttgggaggctgagccaggagaatcgcttgaacccgagaggtggaggttgcagtgagccaaaatcccaccactgcactccagcctgggtgacagagtgagaccctgtctcaaaaaaaaggaaaaggactaacaggcagtatgctgtcatgttaatgtggggtggaaaaattgtctgcattttttctgcatttttaaaattccaacacaataaatacaataataactatgctaactaaaaaaaaaaaaaagaaaaaaaaaaacaaaaatacagcggaaaaaaacaaacaccaaaccgacaaaagacaaaagagccaaagacacaccgcacacacaaagcaagaggggggaaagaaaagaaaaaaagcgcgcggccacaacagcaacgcaaaaaggcaaggagagagggaaagtg

SEQ ID NO: 304738 - DNA, 1750 bp, Homo sapiens
gatgtcagatgatctacccgcctcagcctcccagagtgctgggattacagatgtgagccactgtgcccagccgggaacaaatatttttaagtgccaactatgtgccaggcacttgggaaatgataatagtaaaaagacagatccaatctctgcctcatgggtctgtggtttgctggtatatatgagagctggccataacacacagaattgtttcttccatctctgcgaggggtaggaggttctcaccaagagtctgaacaatgctctgggttcccattgctgtttccatgttctcaggatgcctggcaggttttataaactctcagaagtggagctccagggaatacaatgttcattgtcctatttggaaggctgggttgttgtgggtccctgctgggggccggggaaacgtgggcctcctgcctgatttgttttaatctctgaagttcagtggttccagtagctgtttgtgggcttcacttccccttctctgcctttaacaccctgcaggttttcctgttgtcagacagggtggtgagtccctgtgtctctctgtctgtgggggtcaggttgtttgtagatctttcaggaaggtcctgggtggggggccctcctgctttcaaacccataccaagtgctttcctctgaagggaatgtgagggaggaagaaggggggagtttcagagacttctgaggttccccaagagggaagaggtcaaagtacctcctgagcggggagagctactgagttgaactgatttgctttgccatttgctttagcagcagccaggcccagtggcagcaattgtacgtgcatttccaggggtcagttgtccagttcatccctgagccttgagctcccagtcgcagcatctccctcagtcacccaggctggagtgcagtggtgcagtcatagctcacttgcagcctccaacttctgggctcaagtaatcctcctgcctcagcgtccagagtagctaggactacaggaccagttcagattcaaggagaggactacacaagggtgtgaatactaagaggcgtgattcactgaggagagaaacaggcctccttggagaccagctactacttttcagcatccttatgtgaggaccacttgatccttatcactgcttttggcacactcctcatccaagagttgatcgcagaggcagagttccttgccaccagtccagtggaagtacaagccaactttgctctccaaatggcagcagtagctgagcaggccgccctgcattctctcctcataaacatgctgttctcaagtttgtcagaatccagagctctctactcattacccccttttccaaacaagcaagcaaagcatgctcttcctttgtttcccttaattgcctaaaacatctccatgctcatagctgttgactctctttgcctcctagttcctgttcctctggtgtaggatttctcagccctagcactgtaaacatgttgggctggataatcatctcttgtatgggctgtttgtgcattgtaggatgttgagcagcatccctggcttctacacactaagtgccagtgacactcttctcccctccccagctgtaaaacccaaatgtctgcggacattgccaaatgtctcctagggggcaaaatcacccctggttgagagtcactgctctatcatttattcactaaatactgctggtcagctgggtccactggcgaacctcacatcaataaacctggtaatagaagcaaaaaaaaaaaa

SEQ ID NO: 304739 - DNA, 1647 bp, Homo sapiens
  misc_feature (435)..(435): n is a, c, g, or t
tagcactgggttaagagtctctccagacttgtcactgcaagtcacgtaccttttctaggactaagtttcttcactggaagatgaggaggttgcactagatgacctagaaattcccttccagctttaaattccctcttgtgtcacttgctggacttgttctactggacctggcgctcccctgctcctcccttagctgctacgtccgcatcccgcaccagagggcgccacaggctggcccggggcagcgtgcggtgggcggagaggcagaattaggggagtctccaggaggcgtggtgattggccgccgccgggcggaagggggcgtggggagggaaaggccgagcagcgcggtgacgtctcgctggcgggggcggggccgggccgcggagcgtgtgacgctgcggccgccgcggacctggggattaatgggcacanagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgaggggtaggaggttctcaccaagagtctgaacaatgctctgggttcccattgctgtttccatgttctcaggatgcctggcaggtttcagcagccaggcccagtggcagcaattgtacgtgcatttccaggggtcagttgtccagttcatccctgagccttgagctcccagtcgcagcatctccctcagtcacccaggctggagtgcagtggtgcagtcatagctcacttgcagcctccaacttctgggctcaagtaatcctcctgcctcagcgtccagagtagctaggactacaggaccagttcagattcaaggagaggactacacaagggtgtgaatactaagaggcgtgattcactgaggagagaaacaggcctccttggagaccagctactacttttcagcatccttatgtgaggaccacttgatccttatcactgcttttggcacactcctcatccaagagttgatcgcagaggcagagttccttgccaccagtccagtggaagtacaagccaactttgctctccaaatggcagcagtagctgagcaggccgccctgcattctctcctcataaacatgctgttctcaagtttgtcagaatccagagctctctactcattacccccttttccaaacaagcaagcaaagcatgctcttcctttgtttcccttaattgcctaaaacatctccatgctcatagctgttgactctctttgcctcctagttcctgttcctctggtgtaggatttctcagccctagcactgtaaacatgttgggctggataatcatctcttgtatgggctgtttgtgcattgtaggatgttgagcagcatccctggcttctacacactaagtgccagtgacactcttctcccctccccagctgtaaaacccaaatgtctgcggacattgccaaatgtctcctagggggcaaaatcacccctggttgagagtcactgctctatcatttattcactaaatactgctggtcagctgggtccactggcgaacctcacatcaataaacctggtaatagaagcaaaaaaaaaaaa

SEQ ID NO: 304740 - DNA, 1354 bp, Homo sapiens
  misc_feature (435)..(435): n is a, c, g, or t
tagcactgggttaagagtctctccagacttgtcactgcaagtcacgtaccttttctaggactaagtttcttcactggaagatgaggaggttgcactagatgacctagaaattcccttccagctttaaattccctcttgtgtcacttgctggacttgttctactggacctggcgctcccctgctcctcccttagctgctacgtccgcatcccgcaccagagggcgccacaggctggcccggggcagcgtgcggtgggcggagaggcagaattaggggagtctccaggaggcgtggtgattggccgccgccgggcggaagggggcgtggggagggaaaggccgagcagcgcggtgacgtctcgctggcgggggcggggccgggccgcggagcgtgtgacgctgcggccgccgcggacctggggattaatgggcacanagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgaggaccagttcagattcaaggagaggactacacaagggtgtgaatactaagaggcgtgattcactgaggagagaaacaggcctccttggagaccagctactacttttcagcatccttatgtgaggaccacttgatccttatcactgcttttggcacactcctcatccaagagttgatcgcagaggcagagttccttgccaccagtccagtggaagtacaagccaactttgctctccaaatggcagcagtagctgagcaggccgccctgcattctctcctcataaacatgctgttctcaagtttgtcagaatccagagctctctactcattacccccttttccaaacaagcaagcaaagcatgctcttcctttgtttcccttaattgcctaaaacatctccatgctcatagctgttgactctctttgcctcctagttcctgttcctctggtgtaggatttctcagccctagcactgtaaacatgttgggctggataatcatctcttgtatgggctgtttgtgcattgtaggatgttgagcagcatccctggcttctacacactaagtgccagtgacactcttctcccctccccagctgtaaaacccaaatgtctgcggacattgccaaatgtctcctagggggcaaaatcacccctggttgagagtcactgctctatcatttattcactaaatactgctggtcagctgggtccactggcgaacctcacatcaataaacctggtaatagaagcaaaaaaaaaaaa

SEQ ID NO: 304741 - DNA, 1124 bp, Homo sapiens
tgggactacaggcgcccgccaccactcctggctaattttttgtatttttggtagagacagggtttcacggtgttagccaggatggtctcgatctcctgaccttgtgatccgcccgtctcagcctcccaaagtgctgggattacagtcatgagccacgatgcccgacctctttcttatataatttttttttttaatcgggcagccctcagaatcacagcagattcagaaagactccccagaaaagttctttcactcctaacttctacccagcctcatggtcacctcagcagctctcctgagaccgttactaagttctccacagctaatggtaactcagcttggaaagagttctcttgtaggaggatgctgaagggaggttgccaagtggtgtgggaaactgcttcatgcttaagttcacttccatatcatgatactaaaaggtatctaacagctgattttcattgctttcatttgtgatctgctaggaccacttgatccttatcactgcttttggcacactcctcatccaagagttgatcgcagaggcagagttccttgccaccagtccagtggaagtacaagccaactttgctctccaaatggcagcagtagctgagcaggccgccctgcattctctcctcataaacatgctgttctcaagtttgtcagaatccagagctctctactcattacccccttttccaaacaagcaagcaaagcatgctcttcctttgtttcccttaattgcctaaaacatctccatgctcatagctgttgactctctttgcctcctagttcctgttcctctggtgtaggatttctcagccctagcactgtaaacatgttgggctggataatcatctcttgtatgggctgtttgtgcattgtaggatgttgagcagcatccctggcttctacacactaagtgccagtgacactcttctcccctccccagctgtaaaacccaaatgtctgcggacattgccaaatgtctcctagggggcaaaatcacccctggttgagagtcactgctctatcatttattcactaaatactgctggtcagctgggtccactggcgaacctcacatcaataaacctggtaatagaagcaaaaaaaaaaaa

SEQ ID NO: 304742 - DNA, 743 bp, Homo sapiens
  misc_feature (435)..(435): n is a, c, g, or t
tagcactgggttaagagtctctccagacttgtcactgcaagtcacgtaccttttctaggactaagtttcttcactggaagatgaggaggttgcactagatgacctagaaattcccttccagctttaaattccctcttgtgtcacttgctggacttgttctactggacctggcgctcccctgctcctcccttagctgctacgtccgcatcccgcaccagagggcgccacaggctggcccggggcagcgtgcggtgggcggagaggcagaattaggggagtctccaggaggcgtggtgattggccgccgccgggcggaagggggcgtggggagggaaaggccgagcagcgcggtgacgtctcgctggcgggggcggggccgggccgcggagcgtgtgacgctgcggccgccgcggacctggggattaatgggcacanagttttggcaggagcgggagaattctgcggagcctgcgggacggcggcggtggcgccgtaggcagccgggacaggtcagtccgagacgagagaagcggtcagtgttgtacagtgttttgggcatgcacgtgatactcacacagtggcttctgctcaccaacagatgaagacagatgcaccaacgaggaggtgaggagcgcctctttccggccgccatcacatctaggaaggaggagcgtctctgcccggccgcccatcgtctgagatgtggggagcgcctctgccccgccgccccgtctgggatgtga

SEQ ID NO: 304743 - DNA, 273 bp, Homo sapiens
gcaaccaccaccaccacagaaccaccaaccccaacgtcacttggcagattagcaaaagaactagccagacgctgctaggcccctcaggcttctagattcgctctccaccacatttctaccaatttatgctcatcttgataagctcctcctttgaagggtctggaatggtctggagtggtctggaaagcagggtcagatacccctggaaaactgaagcccgtggagcaatgatctctacaggactgcttcaaggtgcgtggtgaacagacgtct

SEQ ID NO: 304744 - DNA, 375 bp, Homo sapiens
aattataaataaagtagctgtaaaatccatgtgcaggtttttgtccggacgtaagttatcaactcgtttgagtaaataataaagagtataattgcgctgggcatggtggctcatgcctgtaatctcagcactttgggaggccgaggcaggtggatcacgaggtcaggagatggagaccatcctggctaacacggtgaaactctgtctctactgaaaatacaaaaaagttagccgggcgtggtggtggagtcttgctctgtcactcaggctggagcacagtgacaccatctcagctcactgcaagccccacctcccaggttcacgccattctcctgcctcaggtgctgcagcagctgggactacagacgcccgtcg

SEQ ID NO: 304745 - DNA, 3210 bp, Homo sapiens
gtttttctaaacagcctgacactgaggggaggcagtgagactgtaagcagtctgggttgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgatctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctgtgcagtgtcagcacctggaagcccccagtgaaggaaccatggactgtgttcatccgctcactgcttttgcctatggctccagctgcaaatttgagtgccagcccggctacagagtgaggggcttggacatgctccgctgcattgactctggacactggtctgcacccttgccaacctgtgaggctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtaacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacaataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttccccaaaaaccgtgt

SEQ ID NO: 304746 - DNA, 3314 bp, Homo sapiens
gtttttctaaacagcctgacactgaggggaggcagtgagactgtaagcagtctgggttgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgatctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctgtgcagtgtcagcacctggaagcccccagtgaaggaaccatggactgtgttcatccgctcactgcttttgcctatggctccagctgcaaatttgagtgccagcccggctacagagtgaggggcttggacatgctccgctgcattgactctggacactggtctgcacccttgccaacctgtgaggctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtaacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacaataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaagagacctgtccttttcctggtctcctcattcagcctccatatgatcctgttgtgaacatcaagtttcctgctacactggacttaactataatgcatttgctgcaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttccccaaaaaccgtgt

SEQ ID NO: 304747 - DNA, 3090 bp, Homo sapiens
gtttttctaaacagcctgacactgaggggaggcagtgagactgtaagcagtctgggttgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgatctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctgtgcagtgtcagcacctggaagcccccagtgaaggaaccatggactgtgttcatccgctcactgcttttgcctatggctccagctgcaaatttgagtgccagcccggctacagagtgaggggcttggacatgctccgctgcattgactctggacactggtctgcacccttgccaacctgtgaggctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtaacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagatgatgggaaatgccccttgaatcctcacagccacctaggaacatatggagtttttacaaacgctgcatttgacccgagtccttaaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttccccaaaaaccgtgt

SEQ ID NO: 304748 - DNA, 1642 bp, Homo sapiens
atttggctttctgctgaatttcttatatttctgtaccatttcttgcttctttttaaaatagcaacaacaatgactcctctgatttcttctcttggccaggagaatcatctcctcaaggatgatttttaataattttcctcatctggttttctatctctgacactgatagtttttcttaacttccttaaatagctcttgcaggagcctcccttgttatgaagggagtgaaaagcagttattccagattagccttaactctgttaacgcttcttttaattgggaggtctctgaatggaaacattttctcacaacaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacaataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaagagacctgtccttttcctggtctcctcattcagcctccatatgatcctgttgtgaacatcaagtttcctgctacactggacttaactataatgcatttgctgcaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttccccaaaaaccgtgt

SEQ ID NO: 304749 - DNA, 339 bp, Homo sapiens
gatgtggccttgcctgcaaagcagaagtcaggactgctgaaaaatgtttacgaactgttatggagtcaattccctatgctacctgctggaaaaacaaaaataatctgatgctatccctctcccaaaaagtgggtagttgagtgtcctacaaaaagcctgaatggcagaatattcgaaatctagaaagaaaagattatgctgcgcctcagggtgtagatatgatgagcaatttttttctttcttttatttttttaaggaaatgataattatttaaatttctttggtctcatttccagagacctgtccttttcctggtctcctcattcagcctccatatga

SEQ ID NO: 304750 - DNA, 484 bp, Homo sapiens
aaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaatt

SEQ ID NO: 304751 - DNA, 693 bp, Homo sapiens
  misc_feature (1)..(2): n is a, c, g, or t
  misc_feature (4)..(5): n is a, c, g, or t
  misc_feature (13)..(13): n is a, c, g, or t
  misc_feature (15)..(15): n is a, c, g, or t
nncnngaggcctngngcggtacggcgcgcggaggccgtagtgcgaatcatgggaggcggctggtggtgggctcgggccgctcgccttgcccgtcttcgcttccggaggtcgctactgccgcctcagcggccccggagcgggggcgcccgggggtccttcgcccccggccacggtccccgcgccggggcttcgccgcccccagtgtccgagctggatcgtgcggacgcctggctcctccgaaaagcgcacgagacagccttcctctcctggttccgcaatggcctcctggcatcgggcatcggggtcatctccttcatgcagagtgacatgggtcgggaagcagcatatggcttcttcctgctgggcggcctgtgcgtggtgtggggcagcgcctcgtacgccgtgggcctggcggcgctgcgaggacccatgcagctgacgctggggggcgcggccgtgggcgcgggcgccgtgctggccgccagcctgctctgggcgtgcgccgtgggcctctacatggggcagctggagctggacgtggagctggtgcccgaggacgacgggacggcctccgcggaaggccctgatgaggcgggtcggccgccacccgagtgagcgacacggccgtggggcctggcaggcgctggacagcgcccgaggactgggacattaaacctgacctcccctcctcca

SEQ ID NO: 304752 - DNA, 877 bp, Homo sapiens
  misc_feature (1)..(2): n is a, c, g, or t
  misc_feature (4)..(5): n is a, c, g, or t
  misc_feature (13)..(13): n is a, c, g, or t
  misc_feature (15)..(15): n is a, c, g, or t
nncnngaggcctngngcggtacggcgcgcggaggccgtagtgcgaatcatgggaggcggctggtggtgggctcgggccgctcgccttgcccgtcttcgcttccggaggtcgctactgccgcctcagcggccccggagcgggggcgcccgggggtccttcgcccccggccacggtccccgcgccggggcttcgccgcccccagtgtccgagctggatcgtgcggacgcctggctcctccgaaaagcgcacgagacagccttcctctcctggttccgcaatggcctcctggcatcgggcatcggggtcatctccttcatgcagagtgacatgggtcgggaagcagcatatggcttcttcctgctgggcggcctgtgcgtggtgtggggcagcgcctcgtacgccgtgggcctggcggcgctgcgaggacccatgcagctgacgctggggggcgcggccgtgggcgcgggcgccgtgctggccgccagcctgctctgggcgtgcgccgtgggcctctacatggggcagctggagctggacgtggagctggtgcccgaggacgacgggacggcctccgcggaaggccctgatgaggcgggtcggccgccacccgagtgagcgacacggccgtggggcctggcaggcgctggacagcgcccgaggactgggacattaaacctgacctcccctcctccaaaaaaaaaaaaaaaaaaaaaaaaaaaaaacaccggggggtcttattgcggggggggggaaaaggggggttgaaaggggccagggggcctaagtgggttcccgggccccgcgttttttggccacaagggggaaatgggggggcccccaaaagggggggggaaaaaatcgaaaagccggggaaacg

SEQ ID NO: 304753 - DNA, 498 bp, Homo sapiens
acatggttatggtcccctcccctccgatctgattctcaaagatgcaggctagcccctggcacggccctgcctctgttcctgtctcctcaaccctggctttgctcccagaccatcccccgaccttggccctgttgctaccctgcctctcccgcaggcttcttcctgctgggcggcctgtgcgtggtgtggggcagcgcctcgtacgccgtgggcctggcggcgctgcgaggacccatgcagctgacgctggggggcgcggccgtgggcgcgggcgccgtgctggccgccagcctgctctgggcgtgcgccgtgggcctctacatggggcagctggagctggacgtggagctggtgcccgaggacgacgggacggcctccgcggaaggccctgatgaggcgggtcggccgccacccgagtgagcgacacggccgtggggcctggcaggcgctggacagcgcccgaggactgggacattaaacctgacctcccctcctcca

SEQ ID NO: 304754 - DNA, 580 bp, Homo sapiens
  misc_feature (1)..(2): n is a, c, g, or t
  misc_feature (4)..(5): n is a, c, g, or t
  misc_feature (13)..(13): n is a, c, g, or t
  misc_feature (15)..(15): n is a, c, g, or t
nncnngaggcctngngcggtacggcgcgcggaggccgtagtgcgaatcatgggaggcggctggtggtgggctcgggccgctcgccttgcccgtcttcgcttccggaggtcgctactgccgcctcagcggccccggagcgggggcgcccgggggtccttcgcccccggccacggtccccgcgccggggcttcgccgcccccagtgtccgagctggatcgtgcggacgcctggctcctccgaaaagcgcacgagacagccttcctctcctggttccgcaatggcctcctggcatcgggcatcggggtcatctccttcatgcagactgacgctggggggcgcggccgtgggcgcgggcgccgtgctggccgccagcctgctctgggcgtgcgccgtgggcctctacatggggcagctggagctggacgtggagctggtgcccgaggacgacgggacggcctccgcggaaggccctgatgaggcgggtcggccgccacccgagtgagcgacacggccgtggggcctggcaggcgctggacagcgcccgaggactgggacattaaacctgacctcccctcctcca

SEQ ID NO: 304755 - DNA, 3236 bp, Homo sapiens
atctttgatcaatgtacttgccagggagagcccaagtccttcaaacctcctccttttcaccttcatccttaactttgtgctagagcgagacccacacaacaacagccgaccctccccgccccacccccacccccaaaccagccctcgatcccagcccccggagaggactcgcatttcgacttgcgggacacttttgtgcgttcctctccagagcgcctctcgtgctcgcccctcttgcgctcgctctttattaccttcacctccttttctcccccttctctccctttctccttctcgttctctcccggagttgttgttgcccccctcgctccttctccccccttttttccccttcccctcccgggggtgtgtggcaacttttcctctcgcttctcctccgtctgtttccccttatatgtgaccatggcagtgccggcggctttgatccctccgacccagctggtcccccctcaacccccaatctccacgtctgcttcctcctctggcaccaccacctccacctcttcggcgacttcgtctccggctccttccatcggacccccggcgtcctctgggccaactctgttccgcccggagcccatcgcttcggcggcggcggcggcggccacagtcacctctaccggcggcggcggcggcggcggcggcagcggaggcggcggcggcagcagcggcaacggaggcggcggtggcggcggcggcggtggcagcaactgcaaccccaacctggcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacaggtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcggactggaacttccttttatgatgatgccccaccctctaattcctgtcagcctacctccagcatctgtcaccatggcaatgagccagatgaaccacctcagcaccattgcaaatatggcagcagcagcacaagttcagagtcccccatccagagttgagacatcagttattaaggagcgtgttcctgatagcccctcacctgccccctctctggaggaggggagaaggcctggcagtcacccatcatcacatcgcagcagcagcgtgtccagctcccctgctcggactgagagctcttctgacagaatcccggtccatcagaatgggttgtccatgaaccagatgctgatgggcttatcaccaaatgtacttcctgggcccaaagagggagatttggccggtcatgacatgggacatgagtcaaaaaggatgcatattgaaaaagatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggttttttttt

SEQ ID NO: 304756 - DNA, 5232 bp, Homo sapiens
atctttgatcaatgtacttgccagggagagcccaagtccttcaaacctcctccttttcaccttcatccttaactttgtgctagagcgagacccacacaacaacagccgaccctccccgccccacccccacccccaaaccagccctcgatcccagcccccggagaggactcgcatttcgacttgcgggacacttttgtgcgttcctctccagagcgcctctcgtgctcgcccctcttgcgctcgctctttattaccttcacctccttttctcccccttctctccctttctccttctcgttctctcccggagttgttgttgcccccctcgctccttctccccccttttttccccttcccctcccgggggtgtgtggcaacttttcctctcgcttctcctccgtctgtttccccttatatgtgaccatggcagtgccggcggctttgatccctccgacccagctggtcccccctcaacccccaatctccacgtctgcttcctcctctggcaccaccacctccacctcttcggcgacttcgtctccggctccttccatcggacccccggcgtcctctgggccaactctgttccgcccggagcccatcgcttcggcggcggcggcggcggccacagtcacctctaccggcggcggcggcggcggcggcggcagcggaggcggcggcggcagcagcggcaacggaggcggcggtggcggcggcggcggtggcagcaactgcaaccccaacctggcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacaggtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcggactggaacttccttttatgatgatgccccaccctctaattcctgtcagcctacctccagcatctgtcaccatggcaatgagccagatgaaccacctcagcaccattgcaaatatggcagcagcagcacaagttcagagtcccccatccagagttgagacatcagttattaaggagcgtgttcctgatagcccctcacctgccccctctctggaggaggggagaaggcctggcagtcacccatcatcacatcgcagcagcagcgtgtccagctcccctgctcggactgagagctcttctgacagaatcccggtccatcagaatgggttgtccatgaaccagatgctgatgggcttatcaccaaatgtacttcctgggcccaaagagggagatttggccggtcatgacatgggacatgagtcaaaaaggatgcatattgaaaaagatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggttttttttttcttaaaaaaaaaaaaaaatatataaatgtaacatgttttcattccaaactggtagtggtatatagaattaaagataataatgttgcttcttattcaaactgttggtcatatgtacagtatataaacataaaacacacaaggaaggtattatgtatgcagtagtatactagagtttaggaaaatgaaaattttagaaaatatgttttgtcaccctgttggtcagaaagatgtctttctggttttaacgcatgcaggcatgtaaatatttgtctggagtcacagtattaatgaatgagatcttaagcatctggtgacatcagaactctgtgtcagccacttttatttgtatattgaaccctaggctagtgccccaagctgcactattgggaatggattgtggctgaacagcaaatcaaaacaccagaaatatttttatatgttaacgtcatattatgttaatgttgctgaaaacaaaacctaacaaaccttgatgtaccagtccaataccatgtagcgctgagtgataaagttaaaatgtgctgtgcttcccacccttgtcagagggaagggtggctatgtgttattttcactgtctttttgaaagttacagtatgtgttttcactttcgtgcagataactggaagtaaagcggcaaacagtgcttattacatgctaaagttaccttctctttgttttttgcatatctggaattacacctttaaagactgatatgaatcagtacggtcactatacattttatgatttttctgtcatcttaaaattgtatgatcgtaacattatttattaccacaaaacagcaaaatcttcaatgtctaagaaaactagcttaaaatgtttaaatatagttctgattgggtattaattacttgattaagaaaaaattaacattatagatactctggcattacgcttctataccttttaggtcttccttgcaatactggaacataattcttttgtgtagctcactattagccagctaagttcatctttttaataccataaaaaggttatatgtacagttcctattttagcttgcttacaaagggagcattatttttatttaaagtattgctagtaaatgatttgtagaaacttggttttctaagcatagttcttccataaccaccttttgttgtttgagcacaagggattcttttcctagttctatgtgtttgtttccctatatgcagtctttaaaggattacaacacttaaaattgaatggacttgtgtcaagctttttgcatcatacattttttgaaagatttttaaaaaagcctacaacttacatatgtagtagaatcagccattgctctgctcctggcatagagtcacctgttatgtggattaaatagttttaaaatacatatttgaagacctttgagaatgctttagtgtttgatttgaaataaaaggaaattttagcaaggattaaagaaaaaagctatcagctgtatgttaagagagactcttactaacatgttgtaaatattacaattcatgaaatgttattgtaagtctgtaacttaattttttccctgttttagttatacaggttggtttggaaatttgtgttttggcataaacaagtaaaatgtgcccattttatggtttccatgcttttgtaatcctaaaaatattaatgtctagttgttctatattataaccacatttgcgctctatgcaagcccttggaacagaacatactcatcttcatgtaggacctatgaaaattgtctatttttatctatatatttaaagttttctaaaaatgataaaaggttattacgaattttgttgtacaaaatctgtacaaaaatctgtttttacatcataatgcaagaattggaaatttttctatggtagcctagttatttgagcctggtttcaatgtgagaaccacgtttactgttattgtatttaattttcttttccttttcaacaatctcctaataaaactgtctgaaatctc

SEQ ID NO: 304757 - DNA, 749 bp, Homo sapiens
tcccccaccccgcccacccccccccaccccttctctcagtatctcatattcccccgcgctgttctagacctggaaggcctcctaagaggactcaaagtgtcacctccccagagaactctcacatcatgccgcattctgtccctggtctcatgtctcctgggataattccaccaacaggtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcggactggaacttccttttatgatgatgccccaccctctaattcctgtcagcctacctccagcatctgtcaccatggcaatgagccagatgaaccacctcagcaccattgcaaatatggcagcagcagcacaagttcagagtcccccatccagagttgagacatcagttattaaggagcgtgttcctgatagcccctcacctgccccctctctggaggaggggagaaggcctggcagtcacccatcatcacatcgcagcagcagcgtgtccagctcccctgctcggactgagagctcttctgacagaatccgcaggtctcatacttctacttgtcaccattttaaactttattagggatcagctggattttctaatcaacatgccctcattccaaatagatctcagatggat

SEQ ID NO: 304758 - DNA, 4895 bp, Homo sapiens
atctttgatcaatgtacttgccagggagagcccaagtccttcaaacctcctccttttcaccttcatccttaactttgtgctagagcgagacccacacaacaacagccgaccctccccgccccacccccacccccaaaccagccctcgatcccagcccccggagaggactcgcatttcgacttgcgggacacttttgtgcgttcctctccagagcgcctctcgtgctcgcccctcttgcgctcgctctttattaccttcacctccttttctcccccttctctccctttctccttctcgttctctcccggagttgttgttgcccccctcgctccttctccccccttttttccccttcccctcccgggggtgtgtggcaacttttcctctcgcttctcctccgtctgtttccccttatatgtgaccatggcagtgccggcggctttgatccctccgacccagctggtcccccctcaacccccaatctccacgtctgcttcctcctctggcaccaccacctccacctcttcggcgacttcgtctccggctccttccatcggacccccggcgtcctctgggccaactctgttccgcccggagcccatcgcttcggcggcggcggcggcggccacagtcacctctaccggcggcggcggcggcggcggcggcagcggaggcggcggcggcagcagcggcaacggaggcggcggtggcggcggcggcggtggcagcaactgcaaccccaacctggcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacaggtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcggactggaacttccttttatgatgatgccccaccctctaattcctgtcagcctacctccagcatctgtcaccatggcaatgagccagatgaaccacctcagcaccattgcaaatatggcagcagcagcacaagttcagagtcccccatccagagttgagacatcagttattaaggagcgtgttcctgatagcccctcacctgccccctctctggaggaggggagaaggcctggcagtcacccatcatcacatcgcagcagcagcgtgtccagctcccctgctcggactgagagctcttctgacagaatcccggtccatcagaatgggttgtccatgaaccagatgctgatgggcttatcaccaaatgtacttcctgggcccaaagagggagatttggccggtcatgacatgggacatgagtcaaaaaggatgcatattgaaaaagatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggttttttttttcttaaaaaaaaaaaaaaatatataaatgtaacatgttttcattccaaactggtagtggtatatagaattaaagataataatgttgcttcttattcaaactgttggtcatatgtacagtatataaacataaaacacacaaggaaggtattatgtatgcagtagtatactagagtttaggaaaatgaaaattttagaaaatatgttttgtcaccctgttggtcagaaagatgtctttctggttttaacgcatgcaggcatgtaaatatttgtctggagtcacagtattaatgaatgagatcttaagcatctggtgacatcagaactctgtgtcagccacttttatttgtatattgaaccctaggctagtgccccaagctgcactattgggaatggattgtggctgaacagcaaatcaaaacaccagaaatatttttatatgttaacgtcatattatgttaatgttgctgaaaacaaaacctaacaaaccttgatgtaccagtccaataccatgtagcgctgagtgataaagttaaaatgtgctgtgcttcccacccttgtcagagggaagggtggctatgtgttattttcactgtctttttgaaagttacagtatgtgttttcactttcgtgcagataactggaagtaaagcggcaaacagtgcttattacatgctaaagttaccttctctttgttttttgcatatctggaattacacctttaaagactgatatgaatcagtacggtcactatacattttatgatttttctgtcatcttaaaattgtatgatcgtaacattatttattaccacaaaacagcaaaatcttcaatgtctaagaaaactagcttaaaatgtttaaatatagttctgattgggtattaattacttgattaagaaaaaattaacattatagatactctggcattacgcttctataccttttaggtcttccttgcaatactggaacataattcttttgtgtagctcactattagccagctaagttcatctttttaataccataaaaaggttatatgtacagttcctattttagcttgcttacaaagggagcattatttttatttaaagtattgctagtaaatgatttgtagaaacttggttttctaagcatagttcttccataaccaccttttgttgtttgagcacaagggattcttttcctagttctatgtgtttgtttccctatatgcagtctttaaaggattacaacacttaaaattgaatggacttgtgtcaagctttttgcatcatacattttttgaaagatttttaaaaaagcctacaacttacatatgtagtagaatcagccattgctctgctcctggcatagagtcacctgcgctctatgcaagcccttggaacagaacatactcatcttcatgtaggacctatgaaaattgtctatttttatctatatatttaaagttttctaaaaatgataaaaggttattacgaattttgttgtacaaaatctgtacaaaaatctgtttttacatcataatgcaagaattggaaatttttctatggtagcctagttatttgagcctggtttcaatgtgagaaccacgtttactgttattgtatttaattttcttttccttttcaacaatctcctaataaaactgtctgaaatctc

SEQ ID NO: 304759 - DNA, 5097 bp, Homo sapiens
atctttgatcaatgtacttgccagggagagcccaagtccttcaaacctcctccttttcaccttcatccttaactttgtgctagagcgagacccacacaacaacagccgaccctccccgccccacccccacccccaaaccagccctcgatcccagcccccggagaggactcgcatttcgacttgcgggacacttttgtgcgttcctctccagagcgcctctcgtgctcgcccctcttgcgctcgctctttattaccttcacctccttttctcccccttctctccctttctccttctcgttctctcccggagttgttgttgcccccctcgctccttctccccccttttttccccttcccctcccgggggtgtgtggcaacttttcctctcgcttctcctccgtctgtttccccttatatgtgaccatggcagtgccggcggctttgatccctccgacccagctggtcccccctcaacccccaatctccacgtctgcttcctcctctggcaccaccacctccacctcttcggcgacttcgtctccggctccttccatcggacccccggcgtcctctgggccaactctgttccgcccggagcccatcgcttcggcggcggcggcggcggccacagtcacctctaccggcggcggcggcggcggcggcggcagcggaggcggcggcggcagcagcggcaacggaggcggcggtggcggcggcggcggtggcagcaactgcaaccccaacctggcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacaggtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcggactggaacttccttttatgatgatgccccaccctctaattcctgtcagcctacctccagcatctgtcaccatggcaatgagccagatgaaccacctcagcaccattgcaaatatggcagcagcagcacaagttcagagtcccccatccagagttgagacatcagttattaaggagcgtgttcctgatagcccctcacctgccccctctctggaggaggggagaaggcctggcagtcacccatcatcacatcgcagcagcagcgtgtccagctcccctgctcggactgagagctcttctgacagaatccatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggttttttttttcttaaaaaaaaaaaaaaatatataaatgtaacatgttttcattccaaactggtagtggtatatagaattaaagataataatgttgcttcttattcaaactgttggtcatatgtacagtatataaacataaaacacacaaggaaggtattatgtatgcagtagtatactagagtttaggaaaatgaaaattttagaaaatatgttttgtcaccctgttggtcagaaagatgtctttctggttttaacgcatgcaggcatgtaaatatttgtctggagtcacagtattaatgaatgagatcttaagcatctggtgacatcagaactctgtgtcagccacttttatttgtatattgaaccctaggctagtgccccaagctgcactattgggaatggattgtggctgaacagcaaatcaaaacaccagaaatatttttatatgttaacgtcatattatgttaatgttgctgaaaacaaaacctaacaaaccttgatgtaccagtccaataccatgtagcgctgagtgataaagttaaaatgtgctgtgcttcccacccttgtcagagggaagggtggctatgtgttattttcactgtctttttgaaagttacagtatgtgttttcactttcgtgcagataactggaagtaaagcggcaaacagtgcttattacatgctaaagttaccttctctttgttttttgcatatctggaattacacctttaaagactgatatgaatcagtacggtcactatacattttatgatttttctgtcatcttaaaattgtatgatcgtaacattatttattaccacaaaacagcaaaatcttcaatgtctaagaaaactagcttaaaatgtttaaatatagttctgattgggtattaattacttgattaagaaaaaattaacattatagatactctggcattacgcttctataccttttaggtcttccttgcaatactggaacataattcttttgtgtagctcactattagccagctaagttcatctttttaataccataaaaaggttatatgtacagttcctattttagcttgcttacaaagggagcattatttttatttaaagtattgctagtaaatgatttgtagaaacttggttttctaagcatagttcttccataaccaccttttgttgtttgagcacaagggattcttttcctagttctatgtgtttgtttccctatatgcagtctttaaaggattacaacacttaaaattgaatggacttgtgtcaagctttttgcatcatacattttttgaaagatttttaaaaaagcctacaacttacatatgtagtagaatcagccattgctctgctcctggcatagagtcacctgttatgtggattaaatagttttaaaatacatatttgaagacctttgagaatgctttagtgtttgatttgaaataaaaggaaattttagcaaggattaaagaaaaaagctatcagctgtatgttaagagagactcttactaacatgttgtaaatattacaattcatgaaatgttattgtaagtctgtaacttaattttttccctgttttagttatacaggttggtttggaaatttgtgttttggcataaacaagtaaaatgtgcccattttatggtttccatgcttttgtaatcctaaaaatattaatgtctagttgttctatattataaccacatttgcgctctatgcaagcccttggaacagaacatactcatcttcatgtaggacctatgaaaattgtctatttttatctatatatttaaagttttctaaaaatgataaaaggttattacgaattttgttgtacaaaatctgtacaaaaatctgtttttacatcataatgcaagaattggaaatttttctatggtagcctagttatttgagcctggtttcaatgtgagaaccacgtttactgttattgtatttaattttcttttccttttcaacaatctcctaataaaactgtctgaaatctc

SEQ ID NO: 304760 - DNA, 5277 bp, Homo sapiens
atctttgatcaatgtacttgccagggagagcccaagtccttcaaacctcctccttttcaccttcatccttaactttgtgctagagcgagacccacacaacaacagccgaccctccccgccccacccccacccccaaaccagccctcgatcccagcccccggagaggactcgcatttcgacttgcgggacacttttgtgcgttcctctccagagcgcctctcgtgctcgcccctcttgcgctcgctctttattaccttcacctccttttctcccccttctctccctttctccttctcgttctctcccggagttgttgttgcccccctcgctccttctccccccttttttccccttcccctcccgggggtgtgtggcaacttttcctctcgcttctcctccgtctgtttccccttatatgtgaccatggcagtgccggcggctttgatccctccgacccagctggtcccccctcaacccccaatctccacgtctgcttcctcctctggcaccaccacctccacctcttcggcgacttcgtctccggctccttccatcggacccccggcgtcctctgggccaactctgttccgcccggagcccatcgcttcggcggcggcggcggcggccacagtcacctctaccggcggcggcggcggcggcggcggcagcggaggcggcggcggcagcagcggcaacggaggcggcggtggcggcggcggcggtggcagcaactgcaaccccaacctggcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacaggtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcggactggaacttccttttatgatgatgccccaccctctaattcctgtcagcctacctccagcatctgtcaccatggcaatgagccagatgaaccacctcagcaccattgcaaatatggcagcagcagcacaagttcagagtcccccatccagagttgagacatcagttattaaggagcgtgttcctgatagcccctcacctgccccctctctggaggaggggagaaggcctggcagtcacccatcatcacatcgcagcagcagcgtgtccagctcccctgctcggactgagagctcttctgacagaatcccggtccatcagaatgggttgtccatgaaccagatgctgatgggcttatcaccaaatgtacttcctgggcccaaagagggagatttggccggtcatgacatgggacatgagtcaaaaaggatgcatattgaaaaagatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatggaatcaaatgaaatatgtgtcactcttacctttctgtgcttttagactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggttttttttttcttaaaaaaaaaaaaaaatatataaatgtaacatgttttcattccaaactggtagtggtatatagaattaaagataataatgttgcttcttattcaaactgttggtcatatgtacagtatataaacataaaacacacaaggaaggtattatgtatgcagtagtatactagagtttaggaaaatgaaaattttagaaaatatgttttgtcaccctgttggtcagaaagatgtctttctggttttaacgcatgcaggcatgtaaatatttgtctggagtcacagtattaatgaatgagatcttaagcatctggtgacatcagaactctgtgtcagccacttttatttgtatattgaaccctaggctagtgccccaagctgcactattgggaatggattgtggctgaacagcaaatcaaaacaccagaaatatttttatatgttaacgtcatattatgttaatgttgctgaaaacaaaacctaacaaaccttgatgtaccagtccaataccatgtagcgctgagtgataaagttaaaatgtgctgtgcttcccacccttgtcagagggaagggtggctatgtgttattttcactgtctttttgaaagttacagtatgtgttttcactttcgtgcagataactggaagtaaagcggcaaacagtgcttattacatgctaaagttaccttctctttgttttttgcatatctggaattacacctttaaagactgatatgaatcagtacggtcactatacattttatgatttttctgtcatcttaaaattgtatgatcgtaacattatttattaccacaaaacagcaaaatcttcaatgtctaagaaaactagcttaaaatgtttaaatatagttctgattgggtattaattacttgattaagaaaaaattaacattatagatactctggcattacgcttctataccttttaggtcttccttgcaatactggaacataattcttttgtgtagctcactattagccagctaagttcatctttttaataccataaaaaggttatatgtacagttcctattttagcttgcttacaaagggagcattatttttatttaaagtattgctagtaaatgatttgtagaaacttggttttctaagcatagttcttccataaccaccttttgttgtttgagcacaagggattcttttcctagttctatgtgtttgtttccctatatgcagtctttaaaggattacaacacttaaaattgaatggacttgtgtcaagctttttgcatcatacattttttgaaagatttttaaaaaagcctacaacttacatatgtagtagaatcagccattgctctgctcctggcatagagtcacctgttatgtggattaaatagttttaaaatacatatttgaagacctttgagaatgctttagtgtttgatttgaaataaaaggaaattttagcaaggattaaagaaaaaagctatcagctgtatgttaagagagactcttactaacatgttgtaaatattacaattcatgaaatgttattgtaagtctgtaacttaattttttccctgttttagttatacaggttggtttggaaatttgtgttttggcataaacaagtaaaatgtgcccattttatggtttccatgcttttgtaatcctaaaaatattaatgtctagttgttctatattataaccacatttgcgctctatgcaagcccttggaacagaacatactcatcttcatgtaggacctatgaaaattgtctatttttatctatatatttaaagttttctaaaaatgataaaaggttattacgaattttgttgtacaaaatctgtacaaaaatctgtttttacatcataatgcaagaattggaaatttttctatggtagcctagttatttgagcctggtttcaatgtgagaaccacgtttactgttattgtatttaattttcttttccttttcaacaatctcctaataaaactgtctgaaatctc

SEQ ID NO: 304761 - DNA, 3908 bp, Homo sapiens
agcgagaggcggcgctggcgttggagagcgacggcagcgcggtggcggctgcgaacaccgtttgtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcggactggaacttccttttatgatgatgccccaccctctaattcctgtcagcctacctccagcatctgtcaccatggcaatgagccagatgaaccacctcagcaccattgcaaatatggcagcagcagcacaagttcagagtcccccatccagagttgagacatcagttattaaggagcgtgttcctgatagcccctcacctgccccctctctggaggaggggagaaggcctggcagtcacccatcatcacatcgcagcagcagcgtgtccagctcccctgctcggactgagagctcttctgacagaatcccggtccatcagaatgggttgtccatgaaccagatgctgatgggcttatcaccaaatgtacttcctgggcccaaagagggagatttggccggtcatgacatgggacatgagtcaaaaaggatgcatattgaaaaagatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggttttttttttcttaaaaaaaaaaaaaaatatataaatgtaacatgttttcattccaaactggtagtggtatatagaattaaagataataatgttgcttcttattcaaactgttggtcatatgtacagtatataaacataaaacacacaaggaaggtattatgtatgcagtagtatactagagtttaggaaaatgaaaattttagaaaatatgttttgtcaccctgttggtcagaaagatgtctttctggttttaacgcatgcaggcatgtaaatatttgtctggagtcacagtattaatgaatgagatcttaagcatctggtgacatcagaactctgtgtcagccacttttatttgtatattgaaccctaggctagtgccccaagctgcactattgggaatggattgtggctgaacagcaaatcaaaacaccagaaatatttttatatgttaacgtcatattatgttaatgttgctgaaaacaaaacctaacaaaccttgatgtaccagtccaataccatgtagcgctgagtgataaagttaaaatgtgctgtgcttcccacccttgtcagagggaagggtggctatgtgttattttcactgtctttttgaaagttacagtatgtgttttcactttcgtgcagataactggaagtaaagcggcaaacagtgcttattacatgctaaagttaccttctctttgttttttgcatatctggaattacacctttaaagactgatatgaatcagtacggtcactatacattttatgatttttctgtcatcttaaaattgtatgatcgtaacattatttattaccacaaaacagcaaaatcttcaatgtctaagaaaactagcttaaaatgtttaaatatagttctgattgggtattaattacttgattaagaaaaaattaacattatagatactctggcattacgcttctataccttttaggtcttccttgcaatactggaacataattcttttgtgtagctcactattagccagctaagttcatctttttaataccataaaaaggttatatgtacagttcctattttagcttgcttacaaagggagcattatttttatttaaagtattgctagtaaatgatttgtagaaacttggttttctaagcatagttcttccataaccaccttttgttgtttgagcacaagggattcttttcctagttctatgtgtttgtttccctatatgcagtctttaaaggattacaacacttaaaattgaatggacttgtgtcaagctttttgcatcatacattttttgaaagatttttaaaaaagcctacaacttacatatgtagtagaatcagccattgctctgctcctggcatagagtcacctgttatgtggattaaatagttttaaaatacatatttgaagacctttgagaatgctttagtgtttgatttgaaataaaaggaaattttagcaaggattaaagaaaaaagctatcagctgtatgttaagagagactcttactaacatgttgtaaatattacaattcatgaaatgttattgtaagtctgtaacttaattttttccctgttttagttatacaggttggtttggaaatttgtgttttggcataaacaagtaaaatgtgcccattttatggtttccatgcttttgtaatcctaaaaatattaatgtctagttgttctatattataaccacatttgcgctctatgcaagcccttggaacagaacatactcatcttcatgtaggacctatgaaaattgtctatttttatctatatatttaaagttttctaaaaatgataaaaggttattacgaattttgttgtacaaaatctgtacaaaaatctgtttttacatcataatgcaagaattggaaatttttctatggtagcctagttatttgagcctggtttcaatgtgagaaccacgtttactgttattgtatttaattttcttttccttttcaacaatctcctaataaaactgtctgaaatctc

SEQ ID NO: 304762 - DNA, 1959 bp, Homo sapiens
atctttgatcaatgtacttgccagggagagcccaagtccttcaaacctcctccttttcaccttcatccttaactttgtgctagagcgagacccacacaacaacagccgaccctccccgccccacccccacccccaaaccagccctcgatcccagcccccggagaggactcgcatttcgacttgcgggacacttttgtgcgttcctctccagagcgcctctcgtgctcgcccctcttgcgctcgctctttattaccttcacctccttttctcccccttctctccctttctccttctcgttctctcccggagttgttgttgcccccctcgctccttctccccccttttttccccttcccctcccgggggtgtgtggcaacttttcctctcgcttctcctccgtctgtttccccttatatgtgaccatggcagtgccggcggctttgatccctccgacccagctggtcccccctcaacccccaatctccacgtctgcttcctcctctggcaccaccacctccacctcttcggcgacttcgtctccggctccttccatcggacccccggcgtcctctgggccaactctgttccgcccggagcccatcgcttcggcggcggcggcggcggccacagtcacctctaccggcggcggcggcggcggcggcggcagcggaggcggcggcggcagcagcggcaacggaggcggcggtggcggcggcggcggtggcagcaactgcaaccccaacctggcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacaggtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcggactggaacttccttttatgatgatgccccaccctctaattcctgtcagcctacctccagcatctgtcaccatggcaatgagccagatgaaccacctcagcaccattgcaaatatggcagcagcagcacaagttcagagtcccccatccagagttgagacatcagttattaaggagcgtgttcctgatagcccctcacctgccccctctctggaggaggggagaaggcctggcagtcacccatcatcacatcgcagcagcagcgtgtccagctcccctgctcggactgagagctcttctgacagaatccgcaggtctcatacttctacttgtcaccattttaaactttattagggatcagctggattttctaatcaacatgccctcattccaaatagatctcagatggat

SEQ ID NO: 304763 - DNA, 962 bp, Homo sapiens
  misc_feature (54)..(54): n is a, c, g, or t
ggtagcagcttccagatagccaggagtgcaagcccaacaaggaggatgctaccnaccacagccaggaggatggtcatggcgttgggggtgtttccacactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgata

SEQ ID NO: 304764 - DNA, 3392 bp, Homo sapiens
  misc_feature (10)..(10): n is a, c, g, or t
  misc_feature (12)..(12): n is a, c, g, or t
gccgccgagngnagccagcccctcccctacccggagcagcccgctggggccgtcccgagcggcgacacactaggagtcccggccggccagccagggcagccgcggtcccgggactcggccgtgagtgctgcgggacggatggtggcggcggggcgcgggccagcgcgggcgccgtgagccggagctgcgcgcggggcatgcggctgcgccccggcccctcggcccccggcctcggcccccgcgctccggccccagccccggccgccggcccccgcggagtgcagcgaccgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgata

SEQ ID NO: 304765 - DNA, 352 bp, Homo sapiens
  misc_feature (22)..(22): n is a, c, g, or t
  misc_feature (24)..(24): n is a, c, g, or t
  misc_feature (29)..(29): n is a, c, g, or t
gcggccgcctactactactatncngctgntagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgata

SEQ ID NO: 304766 - DNA, 3131 bp, Homo sapiens
tgagacagagtctcaccctgtcgcccaggctggagtgcagtggcgagatctcgactcactacaacctctgcctcctgggatcaagcgattctcctgcctcagcctcccgaatagctgggattacaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgata

SEQ ID NO: 304767 - DNA, 3124 bp, Homo sapiens
gagtctcactctgttgcccaggctggagtgcagtggtgcaatctctggtcaccgcaacctctgcctcccaggttcaagcgattctcctgcctcagcctcccgagtagctgggattacaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgata

SEQ ID NO: 304768 - DNA, 3235 bp, Homo sapiens
gcgggcgtctacgtcccatctcaggccgccggcagtgaggctttgggaggatgaggcggtaccggcacgacccccgtacctgctctccctctcgcagtctagcaaccgcctttggcccaagtaatctcggctcgcctaatacagcgtgccccgcccctttcccgtggcgacgggcggctaagcaacgggagcgggctctactcagtggtttcgagccccccacgccccaagtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgata

SEQ ID NO: 304769 - DNA, 4438 bp, Homo sapiens
  misc_feature (10)..(10): n is a, c, g, or t
  misc_feature (12)..(12): n is a, c, g, or t
gccgccgagngnagccagcccctcccctacccggagcagcccgctggggccgtcccgagcggcgacacactaggagtcccggccggccagccagggcagccgcggtcccgggactcggccgtgagtgctgcgggacggatggtggcggcggggcgcgggccagcgcgggcgccgtgagccggagctgcgcgcggggcatgcggctgcgccccggcccctcggcccccggcctcggcccccgcgctccggccccagccccggccgccggcccccgcggagtgcagcgaccgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgatactctctgtgtgtttctttctttctgagcggacttaaaatggtgcccccagtggggattgaagcggccgtgtacttcctcagggatgggacacaggctggtctgatactccagactgcagcttgtcaagtaagcatgaggtgctcggggcagtgagggctgtgcaagggggaacactgagcagatacctttggccccttccagcttttactgacagagagttccaggctagacaccataaaaacaccccttggtctccctcccttgttctgaggggctgaggctggaaatagattgtacagacaagcaagggttgagtggtggttcccacacgaagtcatctcttaaacatcattagcaatagcagttcccttccaaggcctcccctcactcccgaaacacttacgtcccatgcaggcccaatgcaaaaaaacacatttgagcttttttcccgcagggccatgaagtccccttaagttcccatatctaagatggttgactgaccctctccccttatgtacagaagaggaaactgattctcagagaggggaagtggcttgcccgagtgtttgttaggaggttactgaatgacaaactgttcctaagaccccatctcatgctggccagagggccagcctcctcattcctgcttgctcttagaaaatctttcactgatcattttttgtcactggaataacttcaaggttattatgctttcattccaaatggatctgtcctcagctctggacccaattccccttacttcattttggcaaacactaagtcaaatagtgaaatgcctgtcactacatagaacctattacctggggcaaatacgaacagattgagtttccttcatcttgtgtaaatatgatgaaacagagacctggtaacttggtgacactgttaaaccctttttgggataaagccaaatgtaaatgaaaacattaaacagataaattgtggtgttgagacttttctgaattgagaaaaataaatgtaattttggaagaaactttgggtttctctcatgtttaattttgggttt

SEQ ID NO: 304770 - DNA, 3257 bp, Homo sapiens
  misc_feature (10)..(10): n is a, c, g, or t
  misc_feature (12)..(12): n is a, c, g, or t
gccgccgagngnagccagcccctcccctacccggagcagcccgctggggccgtcccgagcggcgacacactaggagtcccggccggccagccagggcagccgcggtcccgggactcggccgtgagtgctgcgggacggatggtggcggcggggcgcgggccagcgcgggcgccgtgagccggagctgcgcgcggggcatgcggctgcgccccggcccctcggcccccggcctcggcccccgcgctccggccccagccccggccgccggcccccgcggagtgcagcgaccgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatgcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgata

SEQ ID NO: 304771 - DNA, 3302 bp, Homo sapiens
  misc_feature (10)..(10): n is a, c, g, or t
  misc_feature (12)..(12): n is a, c, g, or t
gccgccgagngnagccagcccctcccctacccggagcagcccgctggggccgtcccgagcggcgacacactaggagtcccggccggccagccagggcagccgcggtcccgggactcggccgtgagtgctgcgggacggatggtggcggcggggcgcgggccagcgcgggcgccgtgagccggagctgcgcgcggggcatgcggctgcgccccggcccctcggcccccggcctcggcccccgcgctccggccccagccccggccgccggcccccgcggagtgcagcgaccgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgata

SEQ ID NO: 304772 - DNA, 2534 bp, Homo sapiens
atagctgactccagaggatccccttcctctcctcccacctcccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgata

SEQ ID NO: 304773 - DNA, 3346 bp, Homo sapiens
  misc_feature (10)..(10): n is a, c, g, or t
  misc_feature (12)..(12): n is a, c, g, or t
gccgccgagngnagccagcccctcccctacccggagcagcccgctggggccgtcccgagcggcgacacactaggagtcccggccggccagccagggcagccgcggtcccgggactcggccgtgagtgctgcgggacggatggtggcggcggggcgcgggccagcgcgggcgccgtgagccggagctgcgcgcggggcatgcggctgcgccccggcccctcggcccccggcctcggcccccgcgctccggccccagccccggccgccggcccccgcggagtgcagcgaccgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgata

SEQ ID NO: 304774 - DNA, 2783 bp, Homo sapiens
tgagacagagtctcaccctgtcgcccaggctggagtgcagtggcgagatctcgactcactacaacctctgcctcctgggatcaagcgattctcctgcctcagcctcccgaatagctgggattacaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaagagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgata

SEQ ID NO: 304775 - DNA, 2988 bp, Homo sapiens
  misc_feature (10)..(10): n is a, c, g, or t
  misc_feature (12)..(12): n is a, c, g, or t
gccgccgagngnagccagcccctcccctacccggagcagcccgctggggccgtcccgagcggcgacacactaggagtcccggccggccagccagggcagccgcggtcccgggactcggccgtgagtgctgcgggacggatggtggcggcggggcgcgggccagcgcgggcgccgtgagccggagctgcgcgcggggcatgcggctgcgccccggcccctcggcccccggcctcggcccccgcgctccggccccagccccggccgccggcccccgcggagtgcagcgaccgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgaggtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgata

SEQ ID NO: 304776 - DNA, 2879 bp, Homo sapiens
  misc_feature (10)..(10): n is a, c, g, or t
  misc_feature (12)..(12): n is a, c, g, or t
gccgccgagngnagccagcccctcccctacccggagcagcccgctggggccgtcccgagcggcgacacactaggagtcccggccggccagccagggcagccgcggtcccgggactcggccgtgagtgctgcgggacggatggtggcggcggggcgcgggccagcgcgggcgccgtgagccggagctgcgcgcggggcatgcggctgcgccccggcccctcggcccccggcctcggcccccgcgctccggccccagccccggccgccggcccccgcggagtgcagcgaccgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaagcctatctccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttc

SEQ ID NO: 304777 - DNA, 1679 bp, Homo sapiens
  misc_feature (10)..(10): n is a, c, g, or t
  misc_feature (12)..(12): n is a, c, g, or t
gccgccgagngnagccagcccctcccctacccggagcagcccgctggggccgtcccgagcggcgacacactaggagtcccggccggccagccagggcagccgcggtcccgggactcggccgtgagtgctgcgggacggatggtggcggcggggcgcgggccagcgcgggcgccgtgagccggagctgcgcgcggggcatgcggctgcgccccggcccctcggcccccggcctcggcccccgcgctccggccccagccccggccgccggcccccgcggagtgcagcgaccgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacgcatcttttgaagtatcattggagcctttacggataaaaattaacaacagggatgtgtttgaccatgcagaccaatgaggtaccggctctaattgtatac

SEQ ID NO: 304778 - DNA, 1398 bp, Homo sapiens
  misc_feature (22)..(22): n is a, c, g, or t
  misc_feature (24)..(24): n is a, c, g, or t
  misc_feature (29)..(29): n is a, c, g, or t
gcggccgcctactactactatncngctgntagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgatactctctgtgtgtttctttctttctgagcggacttaaaatggtgcccccagtggggattgaagcggccgtgtacttcctcagggatgggacacaggctggtctgatactccagactgcagcttgtcaagtaagcatgaggtgctcggggcagtgagggctgtgcaagggggaacactgagcagatacctttggccccttccagcttttactgacagagagttccaggctagacaccataaaaacaccccttggtctccctcccttgttctgaggggctgaggctggaaatagattgtacagacaagcaagggttgagtggtggttcccacacgaagtcatctcttaaacatcattagcaatagcagttcccttccaaggcctcccctcactcccgaaacacttacgtcccatgcaggcccaatgcaaaaaaacacatttgagcttttttcccgcagggccatgaagtccccttaagttcccatatctaagatggttgactgaccctctccccttatgtacagaagaggaaactgattctcagagaggggaagtggcttgcccgagtgtttgttaggaggttactgaatgacaaactgttcctaagaccccatctcatgctggccagagggccagcctcctcattcctgcttgctcttagaaaatctttcactgatcattttttgtcactggaataacttcaaggttattatgctttcattccaaatggatctgtcctcagctctggacccaattccccttacttcattttggcaaacactaagtcaaatagtgaaatgcctgtcactacatagaacctattacctggggcaaatacgaacagattgagtttccttcatcttgtgtaaatatgatgaaacagagacctggtaacttggtgacactgttaaaccctttttgggataaagccaaatgtaaatgaaaacattaaacagataaattgtggtgttgagacttttctgaattgagaaaaataaatgtaattttggaagaaactttgggtttctctcatgtttaattttgggttt

SEQ ID NO: 304779 - DNA, 492 bp, Homo sapiens
gcgggcgtctacgtcccatctcaggccgccggcagtgaggctttgggaggatgaggcggtaccggcacgacccccgtacctgctctccctctcgcagtctagcaaccgcctttggcccaagtaatctcggctcgcctaatacagcgtgccccgcccctttcccgtggcgacgggcggctaagcaacgggagcgggctctactcagtggtttcgagccccccacgccccaagtgagtcgcaagcgacttccacctgggcccgtagggcctccgcgtcccgggccggtccccgcacagggcggagctggcccggcccggagctcgccccgccccgcctcaccgtaagctgaccgtgtggcggccgggcgagggcctggcaggggagagaaggggaggagaaaggagaggaggaaagtggagcctggcgggccggagggaggaagggaaggggcggaggccaggggcagagtgtgccggcgcgcgggggagtctc

SEQ ID NO: 304780 - DNA, 417 bp, Homo sapiens
gcattgagctctgaccatgggagtgtgaggagctctgggaggccaggaatactgttttatcacccagaaacctctggcttggagcagactcctcaccaggcattagatggaccagagtgcagatggatttgtctcctggtgtcagaatttgaaaggtctgcaacctgacatgtagacaagacatgccactaaactcacacaggctcctccaagaacccttgggcttcctcccataacaagaagaaaggcagagcagaaacattccctgaggctgaacatctgcagctggaaagaagtgaaagccttcccaggtcctgcactgtcaggagctcagggacaggtgtgggactgttctacattatctgacacccacctttatctcctcttttccaaagagattgcgtcgagtgcctgctg

SEQ ID NO: 304781 - DNA, 683 bp, Homo sapiens
atacaggaagggaaaatgtatctcattaattaagaaagcaatggcatactggataccaacagcaaatagcaaagaaatggttgtgtgggtgtgtgtgtttttttttaagggaaaaaaatgaggataaagggaagagaaagtgatgttactaaccctccatgtaatgataatctccaaatagctcttcccagcagttccatacttaagggtcaggatctccattcagggatctttctgtggtgctctaaaggggcagactgaggactttaagggctatcactttcaggtggctttctaagcagcagaattcgtgggatgaggaggacatgcttgttctttacagattcactgaagtgaatctgggggctgatcgatgataacactgtgttgatcccagagatgacaaaggggctgagtgtgagataatggagttcctgaaacccctacgatgaatatgtccacccttccttttcatcagctgctagtccctatctcatccttctcctgtcccaaccccattattcctaaatctgagctcaggcttgccagcacctctaggagtaaatcacaagactgagaccagagcaacaagaaaagcagagacaaatgactcaacaagacagccacaggaggcagggcaaggtggctcacgcttgtaatcccagcactttggaaggccgagg

SEQ ID NO: 304782 - DNA, 397 bp, Homo sapiens
acccttatgtcacaccaaatacaaaaataaactcaaaatgaattaaagtcttaaatgcaatacttgaaactgtaaaagtcttagaagaaaacataggaaaaagcttcttgacatcagtctggacaatgacttttttgatatgatggcaaaagcacaagcaacaaaagcaaacatagacaaatgggattgcatccaactaaaaagcttccgcatagcaaaggaaacaaacaacagagcgaagagacaacctgtgaaatgggaggaaaatatttgcaaaccatacagctgataaggggttaacatccaaaatatacaaggaacacaaatcaatagcaagaaaacacgtaacctgatctaaaaacaagcaaaggatctgaacagacttttctcaaaagaa

SEQ ID NO: 304783 - DNA, 565 bp, Homo sapiens
aaatcatgcctatcactagtatatgtttgacatttgtagtatacttaaaatagtattgggtgtgaggcatggtggtgatgaaaagtagtccttacggctacttgttagtcattagagagaacatggagaaggggtcaaagttggtatcattaacagggcaatgacttgacccttctttcaactgatcttactggtagttgtctctagtttttaagtaaattaatgatggaccatcccccaaacagagaactatgggggtatgaaacaaggctgaaggcttttaaccatgggagaaaaaggtgttggtattattcatatagcataacctgaggttggagaggaccacttgggagcctgtaaccaaaactagaaggtaacttctgggatggacggaggttcccttgaagcagtgccaacctaaatctacctcaggtaagtagttagattaactttttcaagatttcagaccaaacaagacaacttgtattcagttgatgtattcctatgctttaatgtttttgtttgcccttaattattaaataaacatttgttctgaaaaactcca

SEQ ID NO: 304784 - DNA, 1044 bp, Homo sapiens
ataaagaaacagcatactcagctttttacttagtgtcagttgaggcatactctcaaaagttttttcccctaaaatatctttcaagttattactggtatttgaaatttcaagtttagaaattcatttctttttaactcaaagtgcaaatttcatataatgattatgatggttttagtgtccatatttttgtggcttcacttatcatctctttcagcagtagctacccacagtcagctcctagtaaaatggctacaggaaaactgaaagaaaagtttaagcctgagtaggcatagagtaaaaaatgcataatgatgcattattaatataagagtaaggctttttttattttgagtatcctaactccaaacctagtgttcttttcactccattatcctgctgtttatagcaaatcaagacccataatgatacgtctttcatttatttcagttctgccaaggaaagagaaaataccttttaatcccagggaaaggattgcaatcaccacattataaggtatatggcgtggaatgcagaattctaaatactagaagggaaaagtagttggcagattcatcagaggcttaaggataagtacttgtttccaatttaaaagtataattaggattgtctttaatgttctctagaaatactataattaatctagagatctatcaatggtcacatctcagtttttttcttccctgagattcaaagacgtgtaataccaatacttcagattcctatagtatttgggactttgtagactagtgaatagatactttgttgctagtccaaatcctctgattttggtttgatttgtcctagcagatccctgaacttcagagagtattgccatttggattcatggagttggcgaactgctacactgctaccttgtgtatggctctaagctttgatcctaatgactggttgatgatcatgataatattagggccagtgaatatagctcatagtgataataaggattctagggtatttttttttcttttagaaaaagatcctggaagtttatttgatctgaca

SEQ ID NO: 304785 - DNA, 768 bp, Homo sapiens
agtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaagggctgaactctggtggagctacactataaatacactgtatgtgataaaagcttccaccagagttcagcccttcttcaccaatgtgtactgtctgatgttgaagaagg

SEQ ID NO: 304786 - DNA, 1696 bp, Homo sapiens
agtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcgttggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtgggtgagaatctatgtacatataatatgtatgagaagactgttctcatagttagttgactcatatggtagagaggactttacatgaaatcagtatgaaaatagttttttagatacccagaagcttgttctgggagaagctagggtgggtcagagtagacctgatgggtaactcaggt

SEQ ID NO: 304787 - DNA, 1832 bp, Homo sapiens
agtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcgttggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtggttctgccaaggaaagagaaaataccttttaatcccagggaaaggattgcaatcaccacattataagcataacctgaggttggagaggaccacttgggagcctgtaaccaaaactagaaggtaacttctgggatggacggaggttcccttgaagcagtgccaacctaaatctacctcaggtaagtagttagattaactttttcaagatttcagaccaaacaagacaacttgtattcagttgatgtattcctatgctttaatgtttttgtttgcccttaattattaaataaacatttgttctgaaaaactcca

SEQ ID NO: 304788 - DNA, 2118 bp, Homo sapiens
agtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcgttggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtggttctgccaaggaaagagaaaataccttttaatcccagggaaaggattgcaatcaccacattataaggtatatggcgtggaatgcagaattctaaatactagaagggaaaagtagttggcagattcatcagaggcttaaggataagtacttgtttccaatttaaaagtataattaggattgtctttaatgttctctagaaatactataattaatctagagatctatcaatggtcacatctcagtttttttcttccctgagattcaaagacgtgtaataccaatacttcagattcctatagtatttgggactttgtagactagtgaatagatactttgttgctagtccaaatcctctgattttggtttgatttgtcctagcagatccctgaacttcagagagtattgccatttggattcatggagttggcgaactgctacactgctaccttgtgtatggctctaagctttgatcctaatgactggttgatgatcatgataatattagggccagtgaatatagctcatagtgataataaggattctagggtatttttttttcttttagaaaaagatcctggaagtttatttgatctgaca

SEQ ID NO: 304789 - DNA, 9928 bp, Homo sapiens
  misc_feature (308)..(309): n is a, c, g, or t
agtatttctctcgcgagaaaccgctgcgcggacgatacttgaagaggtggggaaaggagggggctgcgggagccgcggcagagactgtgggtgccacaagcggacaggagccacagctgggacagctgcgagcggagccgagcagtggctgtagcggccacgactgggagcagccgccgccgcctcctcgggagtcggagccgccgcttctccactggcaggggccgcctgaagtgggagcagcgcctggagaaggcgggaggagcccggcccgggggacgggcggcgggatagcgggaccccggcgnngcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaagatgtggatgaatgccaggccatccccgggctctgtcagggaggaaattgcattaatactgttgggtcttttgagtgcaaatgccctgctggacacaaacttaatgaagtgtcacaaaaatgtgaagatattgatgaatgcagcaccattcctggaatctgtgaagggggtgaatgtacaaacacagtcagcagttacttttgcaaatgtccccctggtttttacacctctccagatggtaccagatgcatagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccgaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagggtgctgccagtaaacgttactgattactgccagttggtccgctatctctgtcaaaatggacgctgcattccaactcctgggagttaccggtgtgagtgcaacaaagggttccagctggacctccgtggggagtgtattgatgttgatgaatgtgagaaaaacccctgtgctggtggtgagtgtattaacaaccagggttcgtacacctgtcagtgccgagctggatatcagagcacactcacgcggacagaatgccgagacattgatgagtgtttacagaatggccggatctgcaataatggacgctgcatcaacacagatggcagttttcattgcgtgtgtaatgcgggctttcatgttacacgagatgggaagaactgtgaagatatggatgaatgcagcataaggaacatgtgccttaatggaatgtgtatcaatgaagatggcagttttaaatgtatttgcaaacctggattccagctggcatcagatggacgttattgcaaagacattaacgagtgtgaaacccctgggatctgcatgaatgggcgttgcgtcaacactgatggctcctacagatgtgaatgcttccctggactggctgtgggtctggatggccgtgtgtgtgttgacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcagcggaatatcaggcactctgcagcagtgggccaggaatgacgtcagcaggcagtgatataaatgaatgtgcactagatcctgatatttgcccaaatggaatctgtgaaaaccttcgtgggacctataaatgtatatgcaattcaggatatgaagtggattcaactgggaaaaactgcgttgatattaatgaatgtgtactgaacagtctcctttgtgacaatggacaatgtagaaatactcctggaagttttgtctgtacctgccccaagggatttatctacaaacctgatctaaaaacatgtgaagacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatactctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtatgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttctgtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagttta

SEQ ID NO: 304790 - DNA, 707 bp, Homo sapiens
ttggaaggaagtttgcttatcatggtaaacctgaccttgatcagacagcagatgtttattgccctgtgtgcaaggcacatggcaagttcaataagtagactgaggctctgattttcatatgttctcaagaggacctcatttagtccagtatttttccttcaaaaatacatttctcctacataataatatcttaatatctattctgataggattgctcctgtatataaaggacgtggggatttaattctgtggctgaagatctgcagagaggtgtgaggcctggtcagacatttgtctcatttctctgggctgtcaccaactagtgtgttcccttgggaatgtgaaaaaagaaactaagctttactttgttgcttaacaggatgccacacttttactcacacttgtgctttttctctctggttttaaatttgtttgtgattatagagagatacctctctgtgctcctcacagtatttgatcattaacacagaccttatcctattgtaaactatttataaagccttcctaaaaacagggtattaatagaattgtaattatgtgtgttcctaattctcatgttaattataagattttataataagtgatatatatatatacacacacacacacacacacacatacacgggggtgaaaataataatttaaaaatatatacaattaaaagtatttccctgccacctttcaga

SEQ ID NO: 304791 - DNA, 496 bp, Homo sapiens
aattctgcggtgatttagaggatcccgagctctctctgtggggagggatttgagcggtcaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtggatgaaataggatttatgtaacataagaaagtgtaataggatcaaatgtctgattacttatgtgttattttagtaaagctggtgacccaaccctacattggtttggtataatttaacatctgtgcactttgaagtgaaatacattgaagaaccttcagagtgtcagaaaccatgacctggacagcacatctatcctaatttgggggtggactagatctctatgaagtatccaaactgatactgattggactcatatgaggatatcacgtaacatcagacttcaa

SEQ ID NO: 304792 - DNA, 9934 bp, Homo sapiens
  misc_feature (314)..(315): n is a, c, g, or t
ttctggcggggcccgggaggccgagggatcggccggggctgctgcgccgggggcctgggctttccagccagctgtggaccaaacggtcttcccttacccaaattaactgcgccacgcgcaggcggcgcacgggttgggcttgggaatggggaccgcgaggcttcagcatcccgatgccctgaaagtctccccgcctcggggatttgtctctgtgttgcagctggcaggggccgcctgaagtgggagcagcgcctggagaaggcgggaggagcccggcccgggggacgggcggcgggatagcgggaccccggcgnngcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaagatgtggatgaatgccaggccatccccgggctctgtcagggaggaaattgcattaatactgttgggtcttttgagtgcaaatgccctgctggacacaaacttaatgaagtgtcacaaaaatgtgaagatattgatgaatgcagcaccattcctggaatctgtgaagggggtgaatgtacaaacacagtcagcagttacttttgcaaatgtccccctggtttttacacctctccagatggtaccagatgcatagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccgaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagggtgctgccagtaaacgttactgattactgccagttggtccgctatctctgtcaaaatggacgctgcattccaactcctgggagttaccggtgtgagtgcaacaaagggttccagctggacctccgtggggagtgtattgatgttgatgaatgtgagaaaaacccctgtgctggtggtgagtgtattaacaaccagggttcgtacacctgtcagtgccgagctggatatcagagcacactcacgcggacagaatgccgagacattgatgagtgtttacagaatggccggatctgcaataatggacgctgcatcaacacagatggcagttttcattgcgtgtgtaatgcgggctttcatgttacacgagatgggaagaactgtgaagatatggatgaatgcagcataaggaacatgtgccttaatggaatgtgtatcaatgaagatggcagttttaaatgtatttgcaaacctggattccagctggcatcagatggacgttattgcaaagacattaacgagtgtgaaacccctgggatctgcatgaatgggcgttgcgtcaacactgatggctcctacagatgtgaatgcttccctggactggctgtgggtctggatggccgtgtgtgtgttgacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcagcggaatatcaggcactctgcagcagtgggccaggaatgacgtcagcaggcagtgatataaatgaatgtgcactagatcctgatatttgcccaaatggaatctgtgaaaaccttcgtgggacctataaatgtatatgcaattcaggatatgaagtggattcaactgggaaaaactgcgttgatattaatgaatgtgtactgaacagtctcctttgtgacaatggacaatgtagaaatactcctggaagttttgtctgtacctgccccaagggatttatctacaaacctgatctaaaaacatgtgaagacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatactctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtatgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttctgtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagttta

SEQ ID NO: 304793 - DNA, 7161 bp, Homo sapiens
gttttagtgacagttgtatttatttttttaagttacaataaaatgctacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatactctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtatgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttctgtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagttta

SEQ ID NO: 304794 - DNA, 9052 bp, Homo sapiens
atataaaataattagtaggagagtttaacttaatgcaaaacatggaaacaaaaggaaaacaaaattttaaaataaatgacatttgtaacattaacatgctatagttacttggtgaaacaacagtacacaggtttagattttaaaggggggtgatttcattttgccctaatctgttgaatttggtaaatcttttgggtaagtctgtgttgaaagaagcagcatctacctttgaattgactgttctccatgcggtttttactttttaatgatggctgtttccagggacatgatttgactagtgttaacatctgagtccttctactgacgaatggttttatattgtgttctacaaatgctgagattcttttttttatattccagatattgatgaatgcagcaccattcctggaatctgtgaagggggtgaatgtacaaacacagtcagcagttacttttgcaaatgtccccctggtttttacacctctccagatggtaccagatgcatagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccgaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagggtgctgccagtaaacgttactgattactgccagttggtccgctatctctgtcaaaatggacgctgcattccaactcctgggagttaccggtgtgagtgcaacaaagggttccagctggacctccgtggggagtgtattgatgttgatgaatgtgagaaaaacccctgtgctggtggtgagtgtattaacaaccagggttcgtacacctgtcagtgccgagctggatatcagagcacactcacgcggacagaatgccgagacattgatgagtgtttacagaatggccggatctgcaataatggacgctgcatcaacacagatggcagttttcattgcgtgtgtaatgcgggctttcatgttacacgagatgggaagaactgtgaagatatggatgaatgcagcataaggaacatgtgccttaatggaatgtgtatcaatgaagatggcagttttaaatgtatttgcaaacctggattccagctggcatcagatggacgttattgcaaagacattaacgagtgtgaaacccctgggatctgcatgaatgggcgttgcgtcaacactgatggctcctacagatgtgaatgcttccctggactggctgtgggtctggatggccgtgtgtgtgttgacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcagcggaatatcaggcactctgcagcagtgggccaggaatgacgtcagcaggcagtgatataaatgaatgtgcactagatcctgatatttgcccaaatggaatctgtgaaaaccttcgtgggacctataaatgtatatgcaattcaggatatgaagtggattcaactgggaaaaactgcgttgatattaatgaatgtgtactgaacagtctcctttgtgacaatggacaatgtagaaatactcctggaagttttgtctgtacctgccccaagggatttatctacaaacctgatctaaaaacatgtgaagacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatactctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtatgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttctgtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagttta

SEQ ID NO: 304795 - DNA, 10716 bp, Homo sapiens
  misc_feature (314)..(315): n is a, c, g, or t
ttctggcggggcccgggaggccgagggatcggccggggctgctgcgccgggggcctgggctttccagccagctgtggaccaaacggtcttcccttacccaaattaactgcgccacgcgcaggcggcgcacgggttgggcttgggaatggggaccgcgaggcttcagcatcccgatgccctgaaagtctccccgcctcggggatttgtctctgtgttgcagctggcaggggccgcctgaagtgggagcagcgcctggagaaggcgggaggagcccggcccgggggacgggcggcgggatagcgggaccccggcgnngcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaagatgtggatgaatgccaggccatccccgggctctgtcagggaggaaattgcattaatactgttgggtcttttgagtgcaaatgccctgctggacacaaacttaatgaagtgtcacaaaaatgtgaagatattgatgaatgcagcaccattcctggaatctgtgaagggggtgaatgtacaaacacagtcagcagttacttttgcaaatgtccccctggtttttacacctctccagatggtaccagatgcatagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccgaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagggtgctgccagtaaacgttactgattactgccagttggtccgctatctctgtcaaaatggacgctgcattccaactcctgggagttaccggtgtgagtgcaacaaagggttccagctggacctccgtggggagtgtattgatgttgatgaatgtgagaaaaacccctgtgctggtggtgagtgtattaacaaccagggttcgtacacctgtcagtgccgagctggatatcagagcacactcacgcggacagaatgccgagacattgatgagtgtttacagaatggccggatctgcaataatggacgctgcatcaacacagatggcagttttcattgcgtgtgtaatgcgggctttcatgttacacgagatgggaagaactgtgaagatatggatgaatgcagcataaggaacatgtgccttaatggaatgtgtatcaatgaagatggcagttttaaatgtatttgcaaacctggattccagctggcatcagatggacgttattgcaaagacattaacgagtgtgaaacccctgggatctgcatgaatgggcgttgcgtcaacactgatggctcctacagatgtgaatgcttccctggactggctgtgggtctggatggccgtgtgtgtgttgacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcagcggaatatcaggcactctgcagcagtgggccaggaatgacgtcagcaggcagtgatataaatgaatgtgcactagatcctgatatttgcccaaatggaatctgtgaaaaccttcgtgggacctataaatgtatatgcaattcaggatatgaagtggattcaactgggaaaaactgcgttgatattaatgaatgtgtactgaacagtctcctttgtgacaatggacaatgtagaaatactcctggaagttttgtctgtacctgccccaagggatttatctacaaacctgatctaaaaacatgtgaagacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatactctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtatgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttctgtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagtttaccccttggctttgtgttcttgcatggatttggggttggaggggccattccggaggctaaataaagtctcctggatttaaattatcctgggtctcttacttatggcttatgaaagtaccaaatgtataaccactagaagaaaatttaacatatgagtcgatcccttgttttatccattgaaagtagcagagtctggtgtcattaacctgacttgcttgtgagaaatttagattgtagagtcatttctgaaacatgacctaattcatcttgtgacttttaaatagtcttaaataccaagttcagtcattgtcttagagcacatgaatttcattataatagatttatcatgcccccctctcaaatatacacagttttggcaaagccttaggtgttctgttccatttttttttcccctaaacatctttcgttagtcaatgctcatctaattacaaagggataatcccagactgtatccaattgctgtaacttttggtttcttaatgtcataatttttaaagtctgttttattttaagtgcaatattgagtatttagctgttaggctcaatccgtcgatatgaaataattttttaaatccctaagggcaggaaagcatttcgtggtagtgaaaataagaggaaataagatggcatgaaggtggtgggcggagaaactaggtaggacacaggaaagtgctctcaaaaatctttgaagagctcagctgaaaaaaatggagtagatttggctcatactattccggaaggcaaaaccagggtcagctgatg

SEQ ID NO: 304796 - DNA, 2061 bp, Homo sapiens
taagatctgtgaagtgtgacagcacacactgcagtctatgtgtaaacattgcggttcacatgcaatgtctccggattaccaacacatacgtctgcttgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtatgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttctgtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagttta

SEQ ID NO: 304797 - DNA, 1788 bp, Homo sapiens
gagacttccaaaaattataaatcagaaataatgagaaactcatggttttcccccttctagctgatttttttaaaatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtatgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttctgtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagttta

SEQ ID NO: 304798 - DNA, 8590 bp, Homo sapiens
  misc_feature (314)..(315): n is a, c, g, or t
ttctggcggggcccgggaggccgagggatcggccggggctgctgcgccgggggcctgggctttccagccagctgtggaccaaacggtcttcccttacccaaattaactgcgccacgcgcaggcggcgcacgggttgggcttgggaatggggaccgcgaggcttcagcatcccgatgccctgaaagtctccccgcctcggggatttgtctctgtgttgcagctggcaggggccgcctgaagtgggagcagcgcctggagaaggcgggaggagcccggcccgggggacgggcggcgggatagcgggaccccggcgnngcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaagatgtggatgaatgccaggccatccccgggctctgtcagggaggaaattgcattaatactgttgggtcttttgagtgcaaatgccctgctggacacaaacttaatgaagtgtcacaaaaatgtgaagatattgatgaatgcagcaccattcctggaatctgtgaagggggtgaatgtacaaacacagtcagcagttacttttgcaaatgtccccctggtttttacacctctccagatggtaccagatgcatagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccgaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagggtgctgccagtaaacgttactgattactgccagttggtccgctatctctgtcaaaatggacgctgcattccaactcctgggagttaccggtgtgagtgcaacaaagggttccagctggacctccgtggggagtgtattgatgttgatgaatgtgagaaaaacccctgtgctggtggtgagtgtattaacaaccagggttcgtacacctgtcagtgccgagctggatatcagagcacactcacgcggacagaatgccgagacattgatgagtgtttacagaatggccggatctgcaataatggacgctgcatcaacacagatggcagttttcattgcgtgtgtaatgcgggctttcatgttacacgagatgggaagaactgtgaagatatggatgaatgcagcataaggaacatgtgccttaatggaatgtgtatcaatgaagatggcagttttaaatgtatttgcaaacctggattccagctggcatcagatggacgttattgcaaagacattaacgagtgtgaaacccctgggatctgcatgaatgggcgttgcgtcaacactgatggctcctacagatgtgaatgcttccctggactggctgtgggtctggatggccgtgtgtgtgttgacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcagcggaatatcaggcactctgcagcagtgggccaggaatgacgtcagcaggcagtgatataaatgaatgtgcactagatcctgatatttgcccaaatggaatctgtgaaaaccttcgtgggacctataaatgtatatgcaattcaggatatgaagtggattcaactgggaaaaactgcgttgatattaatgaatgtgtactgaacagtctcctttgtgacaatggacaatgtagaaatactcctggaagttttgtctgtacctgccccaagggatttatctacaaacctgatctaaaaacatgtgaagacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatactctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtggtgctgccaatcggtaccagctcgatctatatgtaa

SEQ ID NO: 304799 - DNA, 8767 bp, Homo sapiens
  misc_feature (314)..(315): n is a, c, g, or t
ttctggcggggcccgggaggccgagggatcggccggggctgctgcgccgggggcctgggctttccagccagctgtggaccaaacggtcttcccttacccaaattaactgcgccacgcgcaggcggcgcacgggttgggcttgggaatggggaccgcgaggcttcagcatcccgatgccctgaaagtctccccgcctcggggatttgtctctgtgttgcagctggcaggggccgcctgaagtgggagcagcgcctggagaaggcgggaggagcccggcccgggggacgggcggcgggatagcgggaccccggcgnngcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaagatgtggatgaatgccaggccatccccgggctctgtcagggaggaaattgcattaatactgttgggtcttttgagtgcaaatgccctgctggacacaaacttaatgaagtgtcacaaaaatgtgaagatattgatgaatgcagcaccattcctggaatctgtgaagggggtgaatgtacaaacacagtcagcagttacttttgcaaatgtccccctggtttttacacctctccagatggtaccagatgcatagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccgaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagggtgctgccagtaaacgttactgattactgccagttggtccgctatctctgtcaaaatggacgctgcattccaactcctgggagttaccggtgtgagtgcaacaaagggttccagctggacctccgtggggagtgtattgatgttgatgaatgtgagaaaaacccctgtgctggtggtgagtgtattaacaaccagggttcgtacacctgtcagtgccgagctggatatcagagcacactcacgcggacagaatgccgagacattgatgagtgtttacagaatggccggatctgcaataatggacgctgcatcaacacagatggcagttttcattgcgtgtgtaatgcgggctttcatgttacacgagatgggaagaactgtgaagatatggatgaatgcagcataaggaacatgtgccttaatggaatgtgtatcaatgaagatggcagttttaaatgtatttgcaaacctggattccagctggcatcagatggacgttattgcaaagacattaacgagtgtgaaacccctgggatctgcatgaatgggcgttgcgtcaacactgatggctcctacagatgtgaatgcttccctggactggctgtgggtctggatggccgtgtgtgtgttgacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcagcggaatatcaggcactctgcagcagtgggccaggaatgacgtcagcaggcagtgatataaatgaatgtgcactagatcctgatatttgcccaaatggaatctgtgaaaaccttcgtgggacctataaatgtatatgcaattcaggatatgaagtggattcaactgggaaaaactgcgttgatattaatgaatgtgtactgaacagtctcctttgtgacaatggacaatgtagaaatactcctggaagttttgtctgtacctgccccaagggatttatctacaaacctgatctaaaaacatgtgaagacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatactctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaaatcattaggggtcttggaattgatttatctttcagaaatagattcacaaactcattcataaccagaatatccatttgtaatgggaaatagaagttttggatgacagtttcttcctagttcttcctaagaaaatcttttcaaatgataatcattaatttcttctcacacatggattttgagtgatgcaggttaattgtatcatctaatccagtctgatttacccatatccattgtagcaatgtgtttaacacatgagctagacttacttctttccatgactgctggagggggccgcgcg

SEQ ID NO: 304800 - DNA, 6860 bp, Homo sapiens
  misc_feature (314)..(315): n is a, c, g, or t
ttctggcggggcccgggaggccgagggatcggccggggctgctgcgccgggggcctgggctttccagccagctgtggaccaaacggtcttcccttacccaaattaactgcgccacgcgcaggcggcgcacgggttgggcttgggaatggggaccgcgaggcttcagcatcccgatgccctgaaagtctccccgcctcggggatttgtctctgtgttgcagctggcaggggccgcctgaagtgggagcagcgcctggagaaggcgggaggagcccggcccgggggacgggcggcgggatagcgggaccccggcgnngcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaagatgtggatgaatgccaggccatccccgggctctgtcagggaggaaattgcattaatactgttgggtcttttgagtgcaaatgccctgctggacacaaacttaatgaagtgtcacaaaaatgtgaagatattgatgaatgcagcaccattcctggaatctgtgaagggggtgaatgtacaaacacagtcagcagttacttttgcaaatgtccccctggtttttacacctctccagatggtaccagatgcatagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccgaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagggtgctgccagtaaacgttactgattactgccagttggtccgctatctctgtcaaaatggacgctgcattccaactcctgggagttaccggtgtgagtgcaacaaagggttccagctggacctccgtggggagtgtattgatgttgatgaatgtgagaaaaacccctgtgctggtggtgagtgtattaacaaccagggttcgtacacctgtcagtgccgagctggatatcagagcacactcacgcggacagaatgccgagacattgatgagtgtttacagaatggccggatctgcaataatggacgctgcatcaacacagatggcagttttcattgcgtgtgtaatgcgggctttcatgttacacgagatgggaagaactgtgaagatatggatgaatgcagcataaggaacatgtgccttaatggaatgtgtatcaatgaagatggcagttttaaatgtatttgcaaacctggattccagctggcatcagatggacgttattgcaaagacattaacgagtgtgaaacccctgggatctgcatgaatgggcgttgcgtcaacactgatggctcctacagatgtgaatgcttccctggactggctgtgggtctggatggccgtgtgtgtgttgacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcagcggaatatcaggcactctgcagcagtgggccaggaatgacgtcagcaggcagtgatataaatgaatgtgcactagatcctgatatttgcccaaatggaatctgtgaaaaccttcgtgggacctataaatgtatatgcaattcaggatatgaagtggattcaactgggaaaaactgcgttgatattaatgaatgtgtactgaacagtctcctttgtgacaatggacaatgtagaaatactcctggaagttttgtctgtacctgccccaagggatttatctacaaacctgatctaaaaacatgtgaagacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatggtatgtctgtcatctgcatttctctctgggccatgcagggtgcagactggccatgatgtaagtaagactgtaggccttaaagacagtaacacaatttaatttaattgtaagtctaattagaatgttcattaaaaattattttatct

SEQ ID NO: 304801 - DNA, 6206 bp, Homo sapiens
  misc_feature (314)..(315): n is a, c, g, or t
ttctggcggggcccgggaggccgagggatcggccggggctgctgcgccgggggcctgggctttccagccagctgtggaccaaacggtcttcccttacccaaattaactgcgccacgcgcaggcggcgcacgggttgggcttgggaatggggaccgcgaggcttcagcatcccgatgccctgaaagtctccccgcctcggggatttgtctctgtgttgcagctggcaggggccgcctgaagtgggagcagcgcctggagaaggcgggaggagcccggcccgggggacgggcggcgggatagcgggaccccggcgnngcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaagatgtggatgaatgccaggccatccccgggctctgtcagggaggaaattgcattaatactgttgggtcttttgagtgcaaatgccctgctggacacaaacttaatgaagtgtcacaaaaatgtgaagatattgatgaatgcagcaccattcctggaatctgtgaagggggtgaatgtacaaacacagtcagcagttacttttgcaaatgtccccctggtttttacacctctccagatggtaccagatgcatagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccgaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagggtgctgccagtaaacgttactgattactgccagttggtccgctatctctgtcaaaatggacgctgcattccaactcctgggagttaccggtgtgagtgcaacaaagggttccagctggacctccgtggggagtgtattgatgttgatgaatgtgagaaaaacccctgtgctggtggtgagtgtattaacaaccagggttcgtacacctgtcagtgccgagctggatatcagagcacactcacgcggacagaatgccgagacattgatgagtgtttacagaatggccggatctgcaataatggacgctgcatcaacacagatggcagttttcattgcgtgtgtaatgcgggctttcatgttacacgagatgggaagaactgtgaagatatggatgaatgcagcataaggaacatgtgccttaatggaatgtgtatcaatgaagatggcagttttaaatgtatttgcaaacctggattccagctggcatcagatggacgttattgcaaagacattaacgagtgtgaaacccctgggatctgcatgaatgggcgttgcgtcaacactgatggctcctacagatgtgaatgcttccctggactggctgtgggtctggatggccgtgtgtgtgttgacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcagcggaatatcaggcactctgcagcagtgggccaggaatgacgtcagcaggcagtgatataaatgaatgtgcactagatcctgatatttgcccaaatggaatctgtgaaaaccttcgtgggacctataaatgtatatgcaattcaggatatgaagtggattcaactgggaaaaactgcgttgatattaatgaatgtgtactgaacagtctcctttgtgacaatggacaatgtagaaatactcctggaagttttgtctgtacctgccccaagggatttatctacaaacctgatctaaaaacatgtgaagacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtataggtgcgtgtgcaaaattg

SEQ ID NO: 304802 - DNA, 5617 bp, Homo sapiens
  misc_feature (314)..(315): n is a, c, g, or t
ttctggcggggcccgggaggccgagggatcggccggggctgctgcgccgggggcctgggctttccagccagctgtggaccaaacggtcttcccttacccaaattaactgcgccacgcgcaggcggcgcacgggttgggcttgggaatggggaccgcgaggcttcagcatcccgatgccctgaaagtctccccgcctcggggatttgtctctgtgttgcagctggcaggggccgcctgaagtgggagcagcgcctggagaaggcgggaggagcccggcccgggggacgggcggcgggatagcgggaccccggcgnngcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaagatgtggatgaatgccaggccatccccgggctctgtcagggaggaaattgcattaatactgttgggtcttttgagtgcaaatgccctgctggacacaaacttaatgaagtgtcacaaaaatgtgaagatattgatgaatgcagcaccattcctggaatctgtgaagggggtgaatgtacaaacacagtcagcagttacttttgcaaatgtccccctggtttttacacctctccagatggtaccagatgcatagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccgaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagggtgctgccagtaaacgttactgattactgccagttggtccgctatctctgtcaaaatggacgctgcattccaactcctgggagttaccggtgtgagtgcaacaaagggttccagctggacctccgtggggagtgtattgatgttgatgaatgtgagaaaaacccctgtgctggtggtgagtgtattaacaaccagggttcgtacacctgtcagtgccgagctggatatcagagcacactcacgcggacagaatgccgagacattgatgagtgtttacagaatggccggatctgcaataatggacgctgcatcaacacagatggcagttttcattgcgtgtgtaatgcgggctttcatgttacacgagatgggaagaactgtgaagatatggatgaatgcagcataaggaacatgtgccttaatggaatgtgtatcaatgaagatggcagttttaaatgtatttgcaaacctggattccagctggcatcagatggacgttattgcaaagacattaacgagtgtgaaacccctgggatctgcatgaatgggcgttgcgtcaacactgatggctcctacagatgtgaatgcttccctggactggctgtgggtctggatggccgtgtgtgtgttgacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcagcggaatatcaggcactctgcagcagtgggccaggaatgacgtcagcaggcagtgatataaatgaatgtgcactagatcctgatatttgcccaaatggaatctgtgaaaaccttcgtgggacctataaatgtatatgcaattcaggatatgaagtggattcaactgggaaaaactgcgttgatattaatgaatgtgtactgaacagtctcctttgtgacaatggacaatgtagaaatactcctggaagttttgtctgtacctgccccaagggatttatctacaaacctgatctaaaaacatgtgaagacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactattgcatccttcatcacagcatgtgcaatatgccaagattaccctcggtcattcctgtcaacaaggggtcaatgtcataaatgtcacaataaaacaatctcttcttttttttagttta

SEQ ID NO: 304803 - DNA, 1063 bp, Homo sapiens
  misc_feature (314)..(315): n is a, c, g, or t
ttctggcggggcccgggaggccgagggatcggccggggctgctgcgccgggggcctgggctttccagccagctgtggaccaaacggtcttcccttacccaaattaactgcgccacgcgcaggcggcgcacgggttgggcttgggaatggggaccgcgaggcttcagcatcccgatgccctgaaagtctccccgcctcggggatttgtctctgtgttgcagctggcaggggccgcctgaagtgggagcagcgcctggagaaggcgggaggagcccggcccgggggacgggcggcgggatagcgggaccccggcgnngcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaagggattgctcctgtatataaaggacgtggggatttaattctgtggctgaagatctgcagagaggtgtgaggcctggtcagacatttgtctcatttctctgggctgtcaccaactagtgtgttcccttgggaatgtgaaaaaagaaactaagctttactttgttgcttaacaggatgccacacttttactcacacttgtgctttttctctctggttttaaatttgtttgtgattatagagagatacctctctgtgctcctcacagtatttgatcattaacacagaccttatcctattgtaaactatttataaagccttcctaaaaacagggtattaatagaattgtaattatgtgtgttcctaattctcatgttaattataagattttataataagtgatatatatatatacacacacacacacacacacacatacacgggggtgaaaataataatttaaaaatatatacaattaaaagtatttccctgccacctttcaga

SEQ ID NO: 304804 - DNA, 666 bp, Homo sapiens
  misc_feature (314)..(315): n is a, c, g, or t
ttctggcggggcccgggaggccgagggatcggccggggctgctgcgccgggggcctgggctttccagccagctgtggaccaaacggtcttcccttacccaaattaactgcgccacgcgcaggcggcgcacgggttgggcttgggaatggggaccgcgaggcttcagcatcccgatgccctgaaagtctccccgcctcggggatttgtctctgtgttgcagctggcaggggccgcctgaagtgggagcagcgcctggagaaggcgggaggagcccggcccgggggacgggcggcgggatagcgggaccccggcgnngcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaagggtaaaggaaccggttccctcctttggtgtgggtctcccaagtttcaagatccagaacaacgggcaggatgactctccctgtggaagactccttggcaagac

SEQ ID NO: 304805 - DNA, 280 bp, Homo sapiens
atataaatttgttttcatgtgagaggctttgttgactggacaccagattctgttctccttcaaattcagttctcttctgctcgtagatattgacgagtgtcagaacggcccagtgtgccagcgcaacgccgaatgcatcaacactgcaggcagctaccgctgtgactgtaagcccggctaccgcttcacctccacaggacagtgcaatggtatgtagtgccccacaggctggacatgcctacccaagagtttgtcttcatgaagcttcagatatctggat

SEQ ID NO: 304806 - DNA, 510 bp, Homo sapiens
tcacctctgcctttttccctaaatataggcacacttgggtggagaggctgtttacccttgaccatccctctattctactcatctggtgcatccacagtgcccagaggatacaaagatatctcctacctgtacaaaattgacattctgaagcaaaacccagaacatatatttaaatccagttagactcatgtctggaaagtggtttagttatctcaatttgctattcgttgatgtccctattgccatcaccaccaccccaacacatgcacgcacacacacacacacacacacacacacacacacgcacgcactttccatcttgtcttaccctgcacagggatcatgtgctgtcctgtcactcatgaatgactactctgtctctagatattgatgagtgccgggagatcccaggggtctgtgaaaatggagtgtgtatcaacatggttggcagcttccgatgtgaatgtccagtgggattcttctataatgacaagttgttggtttgtgaag

SEQ ID NO: 304807 - DNA, 477 bp, Homo sapiens
ggtttctccatgttggtcagactggtcttgaactcctgacctcaggtgatccacccgccttggcctctcaaagtgctgggattacaggcgtgaggcaccgtgcctggcctaagcagaaaatttttattagaaagctatctggtagctcactaaatggacaggaaagttgaaataagccaggctcataaaaagatgaaatctacataagatgttatgattcctccgctgctgttagactgatttcttgattgtccctgtgtctgtgagtcaccacacttaagatgcaaacttctggttggcactgtgtgtcttcattgccaagggcagaaggagtatctgggcctttcagcttctacagtggaaggacgctgccgctgtgcagatgctcacagtaccccaggtaagaaggatgcttagatgctggattgcaaaaaatgtacagctgtctactacaaccccaaatctttaaaaaaaaaa

SEQ ID NO: 304808 - DNA, 2441 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggtaaggaaagcgagggtgtgggggccgcgatcaaagagggccccatcgggaacggccagagtgcggcctggggcgtgggagcgcacccagaccctggcgcccggaggctagggggccgcgtggagagggccttgggtccgggcatttcccttctgtttggttaccatcatctctgtgtctggggaagtcggcctccagcttggggagcgggaaaccggagtcagacccgccccatgtggtctgcagcgggagttctggaccggtctgtcttgctcccacctagaccccagtcctggccctgcgaggggattacgcatgttgccgggtaagcgaagggggtttccgtcttcctggactggcggacgtgaagtcttttttttttttttttttttttagtgtcgggtatgcgtttccccaaacaactgaaggactcagccggggctttcactgtctacctcttcctgtgtagtgagggtgggacttgcaatgagcaatgtatgggagggtctggtttaaagacctggttagatgagaggctcttcggggaatcaagaccaaccctacttccgctaggaagtgctgcccaactccggaggagatttgggtagtcttttcacactctaggccgctccatcctctaacttgcgtggtgaatctcggtagctccctgtctttgagatagcgttgatattggtggtgtcagggtaaaggccccgttttaggactgaagaaaagggcatggggccactatagagacattgatagagtcttccttcctttgcatgagaggagtacctttaatttaaagggatgtatgtgtgttttgacattatttgggatcttttgagggtctgacatgcctgatgtttgctggcttataaagctacctggatttccgcattggctggttttcagcctgggttcatagattcatacctcgttagagtacttagaattgtacagtaggcggctctgctgtaagattttcatttggaatgcaccagaagaatcggaggattttttgattgttgagtacttaatagcttactcctgcaaataaaaataatagggtgatactaagcacctaccaagcctaaccccaccatttttcaaaactagattt

SEQ ID NO: 304809 - DNA, 516 bp, Homo sapiens
gcgaattcactagtgattagagactgcgagaaggaggaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctgtgctgccccggctccttctcgcagtctctaatcgaattcccgcggcgccatgcgggccggaagcatgc

SEQ ID NO: 304810 - DNA, 757 bp, Homo sapiens
  misc_feature (734)..(734): n is a, c, g, or t
ctgttgtttattgttccatattttctagtcatatttacatttggtgataattaccttttcttttataagctacctcatctacttttggcctgaagcagtatataagtacgtgatgggtagaaacattaattttgcagtttctggttggtactgtgaacaatagcaacacttttaaatatgctctattttcccctttatttgcttccccaaatataggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctgtacggatnaccgggatcctctagacaccaca

SEQ ID NO: 304811 - DNA, 11338 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304812 - DNA, 11315 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304813 - DNA, 10586 bp, Homo sapiens
ccacatcattttatctttacctctgcatatccaagcaaagcttgtaccttcaaagtatccagccatcgcatagattgttagaaaccatactcatttttcatctatgtccccaacatctcctgtttcagacatgctgccacgattcctgagaggagaagagctagaaagtagccataaagcaccactgctgtaatattcccctttcccccaaggaatgatggaatccccagcagaatttagttttcccactttcgaaacaggaactgtctataaaacattctatggaagaaccaatctgggccctcaagctaacaaaactagctgttttaatttatagaagtacaaaaaataggtagataggaagttgggtgaatagtgaggtgtaataatcttagctgtaaattaaatcaaagtaaagtaaatgaagcaataaattaaataaaggcattttagcctcatcttgatcttggggtctttattcatcaaacactatttcagtaatatgatttgaacgaattctgagaattcttagcagaggaatttgatgtgtattgaaaatgtaaggagtcataatgaaagagaaacaagctcttcacttgcatggtcatcttaaatgagtcctctggaatggtactggtagattactgtcttagactttcatctcctcatggctgatcattagcttttcaaaggagtctaggtgaattttaaagtgatatggctatgaacagtcatcactgaaatgtggaataatttaagagaaagaggcagagagctctatcctgggagggtggtttgtattatcttcagtataaaagttacctttaatgtttttttaaaaaaatctataggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304814 - DNA, 11509 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgacacaaccatttcctacacagtttgcaccccagaagagagctgtgggaagaggactcagccacaagacatttggtcctaggtgttggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304815 - DNA, 9424 bp, Homo sapiens
cagaataaattagaatgcagttaaataataattccaatattacccagttacatttggattgtatttcttatgtagaggagataggaaatgatgtgattatattcttttgccaggatatatgcctgacatgtgtgtttagatttgacaactactgtattgcactttcatagtatatatttattgaaagaacaaattagcactaatgggtcacacacccatctcattccttaatacatttccccccccagaaaccatacagaaataatttttttaattgcaaaaataatgtgtgtacttatgatacagttggtccactttatttcttctgcattttgatttttcagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304816 - DNA, 9175 bp, Homo sapiens
ggggttgcttctacgtgcctcgtactgtcgctctaaccgttcgataggacaatctgatgatgacgaagaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304817 - DNA, 11446 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacgaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304818 - DNA, 11464 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgaaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304819 - DNA, 9408 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgtggaactgcctttgggtggcattgatatcttccgggctacttctacaagtccgac

SEQ ID NO: 304820 - DNA, 11275 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304821 - DNA, 7728 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaatgtaagttgcaaaagagaagtgaggggtggggaatggcataggaatactgaggtttcttttcaattttatttatatactctttaagtgttttctagccatctcattttttattgtaggaaaaagtaatagtaatcctctcaactttcttaaaatttttgttttaagcactgtttaacaagcatattatattttatggaaataattttgtgttgatgagaaaataataggcaatgtttgggggggtcttgtacatgcatatctcatttgattacagtttgtggacactgcatttttaaaaattaaaagttcatggtaactg

SEQ ID NO: 304822 - DNA, 6975 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcatctcgtcaggttttcactttcaacatcctagctccaacaaggtctaacctgctggtggcctgcctcggctccactatggtcctctgccacgggcacactgtccttttttgtgtgtgttccccacattagggctttgtgctcacaatctcctctgc

SEQ ID NO: 304823 - DNA, 8484 bp, Homo sapiens
tagataggacactaaagccaagatccatgaaagaaagaattagtaagctagacttcatcaaaaatgtctgctctgcaaaagacactgtcaagagaatgaaaagcactcaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304824 - DNA, 7286 bp, Homo sapiens
tgcgctgtgggcaacagcagtaaatgtgcacaatttcattgattggcttatggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304825 - DNA, 4955 bp, Homo sapiens
  misc_feature (68)..(68): n is a, c, g, or t
  misc_feature (4860)..(4860): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaaagaaagcaagaaaaagaaaaagaactagaacggcagaaagaaaaggaaaaagaactacaaaaganaaagaacaagagctggagaaggagcaggaaaaacaaagagaaatggagaaagaaagaaagcaagaaaaagaaaaagaactagaacggcagaaaga

SEQ ID NO: 304826 - DNA, 4743 bp, Homo sapiens
  misc_feature (68)..(68): n is a, c, g, or t
  misc_feature (4648)..(4648): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaaggctggagaaggagcaggaaaaacaaagagaaatggagaaagaaagaaagcaagaaaaagaaaaagaactagaacggcagaaagaaaaggaaaaagaactacaaaaganaaagaacaagagctggagaaggagcaggaaaaacaaagagaaatggagaaagaaagaaagcaagaaaaagaaaaagaactagaacggcagaaaga

SEQ ID NO: 304827 - DNA, 4776 bp, Homo sapiens
  misc_feature (68)..(68): n is a, c, g, or t
  misc_feature (4681)..(4681): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaaganaaagaacaagagctggagaaggagcaggaaaaacaaagagaaatggagaaagaaagaaagcaagaaaaagaaaaagaactagaacggcagaaaga

SEQ ID NO: 304828 - DNA, 5451 bp, Homo sapiens
  misc_feature (128)..(128): n is a, c, g, or t
gacaatggaacaaataaagcctccaagaaatatgggactatgtgaaaagattaaacctacaattgattggtgtacctgaaagtgatggggagaacggaaacaagctggaaaacacactttaggatatnatccaggagaacttccccaaccagcaagccaggccaacattcaaattcaggaaatacagagaacaccactaagatactcttcaagaagagcaaccccaagacacataatcatcagattctccaaggttgaaacgaaggaaaaaatgttaagggcagccagagagaaagatcacgttacctacgaagggaagcccatcagactaacagtggatctctctgcagaaaccctatataagctggaagagagtggggaccaatattcaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304829 - DNA, 5056 bp, Homo sapiens
gcgaattcactagtgattagagactgcgagaaggaggaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304830 - DNA, 4778 bp, Homo sapiens
ggcatgactgagtagatgtagtggtccctacttggaggttcgtgggccagtgtcaacagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304831 - DNA, 3393 bp, Homo sapiens
ctgttgtttattgttccatattttctagtcatatttacatttggtgataattaccttttcttttataagctacctcatctacttttggcctgaagcagtatataagtacgtgatgggtagaaacattaattttgcagtttctggttggtactgtgaacaatagcaacacttttaaatatgctctattttcccctttatttgcttccccaaatataggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304832 - DNA, 3131 bp, Homo sapiens
aatatatattttcttcccccctttcccctgactctcctcctcccagcagcttaaaatgtaaatcatggttatatgaaaactctggaatgggtaagatgtgttactatcttagtacttttttccattatgagtcatcaaagtacagttttcttctcaaactgttttcatacccttattggcctaccacatgaggtggttgtattccacagtggattgtgcagttatagatgaagaactcagaaaagcactttgggatccttcatgatgaaaggcactgataaacatgaggtttgctaatgcagaaagagtgcctttaggagtctgtgtggggacagttttgtagcataaaccttacatgtctgccagtacagccagttgaatccgtttatttctatatttactttaggcttgactttcagggatcttagtaatttttgcctgttttgtcactacatatgtcatcagatcagactagaacaaagaaaagcttactgttttcaaacagggaaatgtgcatagtaatgctttactctgaattagaaacatgtttatgataatcctattagaaaatttgattgattgattaaagtgtctttttgggtcgacatccctagcgtttctgatcctgagtaatcaaatttaaagactacccagcagcaaaacttttattaaataattatctacttttattaaggctgtatgcctaggatttccatctgtttgttataattagaaataccagtgtgagtaaaaatcttaggaagttatttggccttggattccagttctactcctggctccttggctcttgattttcgcatattcccatgttggaaataacattagagcttaatagtagtaatggggtgggagagggtacaaacttcttgttgcttcagatctttggatagtacaggttacctatagaacataaagcatttttttaatatgcaagaaggatggaaacttaagttttaattgtgtgttacagtggtaaaatttacagatttgacgtaagtatatttttgggggcacatagtcaaaactaagaaattatttaccagctcagaatgtggtaggagctatcagaacttagtgatcaagtgaagtcgtagttactaatttctgatgctcttcccctgcagaagagagctgtgggaagaggactcagccacaagacatttggtcctaggtgttggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304833 - DNA, 2713 bp, Homo sapiens
aggaaacccagcgagccggataccagctttttgcggtcgctggtgttagacaaaaacacaagtccctattagcccacactcagtgctggccggcggttcagtggcggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304834 - DNA, 2528 bp, Homo sapiens
  misc_feature (34)..(34): n is a, c, g, or t
gctgcaggaattctgcacgagcacacatcttctncaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304835 - DNA, 2609 bp, Homo sapiens
ttttttttttgagatggtgtctggctctgttgcccaggctggattgcagtgacgcggtcttggcttaccaaagtgctgggattacaggcatgagccactgcacctggccgatgtgttctgtttgaaatcttactcaaaagtatttgaagagttgtgtatagttgtatggatatgtctgtagtaaacagaaacaaattgcttcagtttctctttacttattttctaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304836 - DNA, 1195 bp, Homo sapiens
cgttatgttatgctcaaaaagtttggattttggagcatttcggttttttttctctttgagatgaagtcttgctcctgttgcccaagctggagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304837 - DNA, 1147 bp, Homo sapiens
tttacaaccgtcagaattggtccagctacaacagctccagttacaacagcttcagttacaacagctgcagctacaacagcttgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304838 - DNA, 2404 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcaagcaactttggaggtggtggcagatgtgaagatgttccacgttcctgattaaatgaaggtccttacccatagggaactttgctactgatggttggcagtatttggtaccgagctcgatcactgccc

SEQ ID NO: 304839 - DNA, 1380 bp, Homo sapiens
  misc_feature (1320)..(1320): n is a, c, g, or t
aatatatattttcttcccccctttcccctgactctcctcctcccagcagcttaaaatgtaaatcatggttatatgaaaactctggaatgggtaagatgtgttactatcttagtacttttttccattatgagtcatcaaagtacagttttcttctcaaactgttttcatacccttattggcctaccacatgaggtggttgtattccacagtggattgtgcagttatagatgaagaactcagaaaagcactttgggatccttcatgatgaaaggcactgataaacatgaggtttgctaatgcagaaagagtgcctttaggagtctgtgtggggacagttttgtagcataaaccttacatgtctgccagtacagccagttgaatccgtttatttctatatttactttaggcttgactttcagggatcttagtaatttttgcctgttttgtcactacatatgtcatcagatcagactagaacaaagaaaagcttactgttttcaaacagggaaatgtgcatagtaatgctttactctgaattagaaacatgtttatgataatcctattagaaaatttgattgattgattaaagtgtctttttgggtcgacatccctagcgtttctgatcctgagtaatcaaatttaaagactacccagcagcaaaacttttattaaataattatctacttttattaaggctgtatgcctaggatttccatctgtttgttataattagaaataccagtgtgagtaaaaatcttaggaagttatttggccttggattccagttctactcctggctccttggctcttgattttcgcatattcccatgttggaaataacattagagcttaatagtagtaatggggtgggagagggtacaaacttcttgttgcttcagatctttggatagtacaggttacctatagaacataaagcatttttttaatatgcaagaaggatggaaacttaagttttaattgtgtgttacagtggtaaaatttacagatttgacgtaagtatatttttgggggcacatagtcaaaactaagaaattatttaccagctcagaatgtggtaggagctatcagaacttagtgatcaagtgaagtcgtagttactaatttctgatgctcttcccctgcagaagagagctgtgggaagaggactcagccacaagacatttggtcctaggtgttggtaatgccacaatataagtgcttccttttcattttattgtagaccacatattgataactagaagttttaagtgttacatgtatgtttttagatttgcaagcaggttcccgccctgtgttctncaggtgccctcagtttaaggtaatcagcccgccaaagcatcttgtttgggctgcatttcc

SEQ ID NO: 304840 - DNA, 532 bp, Homo sapiens
atcgtttggatcagctccttcatcagaggtaagaataggcttttaacagcataggtgtgctggattttccctaatacttcagtgtggccgggtgtggtggcttacacctgtaatcctagcgtggtgggagggttacttgagtccgggagtttgagaccagcctgggcaacatagtgagacccgcctgggcaatgtaggaagaccctgtctctacatacagaataaaaaatagccagttgtggtggcatgtgcttgtagtctcagctactctggagctgaggttggactgtcacttgagcctgggaggtcaaggctacagtaaagtcataactgtgccactgtactccagcctaggtgatagagcaagaccccacctggaaagcaaaacaatgcttatagcatgcctcagaattaacttggagggcaattaaaacagattgctgagccccatgtccatagttcatgacttattaggtctgggttgaggtttgaataaatgctaacaatttcccaagtgatactcttgctgcta

SEQ ID NO: 304841 - DNA, 306 bp, Homo sapiens
gttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtttaaatcttgtttcaacttgttgctagttatctagatttgttgcccaaagtgtatcagcaaatgttcaaggtttttatacttgtcaaggctgttttcattattcaagtgttaaaagtgacatcatcttcccaacttttaatcattttgaccaga

SEQ ID NO: 304842 - DNA, 254 bp, Homo sapiens
ggtacttttggctttggccaaaccagtgtggggaaaactgatttgtgattggtaaaagaatttgaaccaagattgatttgacaggctttggtaatgctgcagtattttcagttgttctttctcattttttaaggcaaagcagagagcagaggttcttcagtccacgcaacggttcttctctgaacagcaacagagcaaacagataggaggaggcaaagcccagaaagtggacagtgattcaagtaaacctcctg

SEQ ID NO: 304843 - DNA, 421 bp, Homo sapiens
tcctgaaggttgagtggattgtgtgattctgagttgtgtaattgatcgttttcctatcctcacagtacagttgtcattagtaaataattggctaactcttataagacagaacagaaataattcattcttttaagcatttaaattaatttacataggattttgaaaactgaaaaccaggccggggacggtggctcacccctgtaatcccagcactttggaaggccgaggtgggcgattcgcctgaggtcaggagttcaaggccagcctggccagcatggtgaaaccctgtttctattaaaaaagtacaaaacaattagtcggacgtggtggcgtgcacctgtaatcccagctactcgggaggctgaggcaggagaattgcttgaacccaggaggcggaagttgcaatgagccgagattgtgc

SEQ ID NO: 304844 - DNA, 584 bp, Homo sapiens
ttcaagcagccagtctgagttttccttaatttaataggtgctcagatggaagtagattatacagagcaactgaatttcagtgatgatgatgaacaaggaagtaacagtcctaaagagaataacaggtaagttgtgatatcttttactaataacagtatgaatttgttgatacaatattagctacttatgcaaagaagctttgttaatagacaattgtttgttatttgtagaatttatatattctcagaagttttactgaatagagggtgcttaatgagctagattaatacagtatacagctaatcaaggaattaaaatttgatgcgtctcaagaaagtttatttaaaaacatttagggctgggtgcggtggctcacatctgtaatcccagcactttgggaggccgaggcaggcagatcacttgaggtcaggagttcgagaccagcttggccaacatggtgaaaccccatctctactaaaaatacaaaaattatccaggcgtggtggtgcatgcctgtaatcccagctactcaggaggctaaggcaggagaatcacttgaatccgggaggcggaggttgcagtga

SEQ ID NO: 304845 - DNA, 11510 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304846 - DNA, 11453 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagcagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304847 - DNA, 11563 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccagaagagagctgtgggaagaggactcagccacaagacatttggtcctaggtgttggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304848 - DNA, 9812 bp, Homo sapiens
tctaggtacgaggctgggtggccaagagatggaatccaagtgaatagtcagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304849 - DNA, 9344 bp, Homo sapiens
atcccagcactttggaaggccgaggtgggcgattcgcctgagaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304850 - DNA, 9138 bp, Homo sapiens
ccagtattgctcccatcagctgtggaataatggcaacagaaagactggctaactacaccggaggcatctatgccgaataccaggacaccacatatataaaccatgtcgtttccgtggctgggtggggcatcactgatgggcgcagtcttctccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304851 - DNA, 9081 bp, Homo sapiens
ctggattaattattctggtcttagtttggtgaattatctagatgtaatatatttcccatcttatgtgttttcattttaatgtgtatgttcatcagagaaatttctgatatttttgtggggtttttccttctccatgcctgatacccagtgttagtcagaaatagagttgtcataactcatctgataccttaatgtttcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304852 - DNA, 9812 bp, Homo sapiens
  misc_feature (68)..(68): n is a, c, g, or t
  misc_feature (9752)..(9752): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccagaagagagctgtgggaagaggactcagccacaagacatttggtcctaggtgttggtaatgccacaatataagtgcttccttttcattttattgtagaccacatattgataactagaagttttaagtgttacatgtatgtttttagatttgcaagcaggttcccgccctgtgttctncaggtgccctcagtttaaggtaatcagcccgccaaagcatcttgtttgggctgcatttcc

SEQ ID NO: 304853 - DNA, 11400 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304854 - DNA, 8874 bp, Homo sapiens
  misc_feature (68)..(68): n is a, c, g, or t
  misc_feature (8851)..(8851): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctgtacggatnaccgggatcctctagacaccaca

SEQ ID NO: 304855 - DNA, 8992 bp, Homo sapiens
ccattaatgagaagagaccagatggaagggtcaccgacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304856 - DNA, 8850 bp, Homo sapiens
cttctatatggacacaagtcatttattcaatacccaacatgcacggatttgtccgccatccttggctcaacaacagggtttccaaccaggtctctctcagaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccagcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304857 - DNA, 5014 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaaatctccagaggaaattagggaaagggagcgagaaaaagaacgggagcgtgagaaagtccttgaaaaagaacaagctcaggagcgggagggtgacgcctcgtagtctgagttgaagcagcaggaaaaggagaaagagctggagaaggagcaggaaaaacaaagagaaatggagaaagaaagaaagcaagaaaaagaaaaagaactagaacggcagaaaga

SEQ ID NO: 304858 - DNA, 4572 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagagctggagaaggagcaggaaaaacaaagagaaatggagaaagaaagaaagcaagaaaaagaaaaagaactagaacggcagaaaga

SEQ ID NO: 304859 - DNA, 4648 bp, Homo sapiens
  misc_feature (68)..(68): n is a, c, g, or t
  misc_feature (4553)..(4553): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtagaacggcgacagaaggggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccactcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaagaaagcaagaaaaagaaaaagaactagaacggcagaaagaaaaggaaaaagaactacaaaaganaaagaacaagagctggagaaggagcaggaaaaacaaagagaaatggagaaagaaagaaagcaagaaaaagaaaaagaactagaacggcagaaaga

SEQ ID NO: 304860 - DNA, 4928 bp, Homo sapiens
tcccttttgtccctttgctctggataaattaaaccagcaacaacattttcttattctcaaagtctaatccagagcaaagtcctaagtctcctcaattccctgaaggctgagagtggggaagctgtagaagagaattttgaagctagcagatattggtgaggctggaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304861 - DNA, 4300 bp, Homo sapiens
catctgatggaccagcctctcagtgtagatgaagaggggctggtcttactggagcagaagctttccgagcccaagacccagatcaacagccaactgcggcccatgatgtcagagctggaagagagggcacgtcagcagaggggccacctccatttgctggagacaagcatagatgggattctggctgatgtgaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaaaaaaaaa

SEQ ID NO: 304862 - DNA, 2697 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaagggttcaaaacagaaaataagacataacacacacacacaacaaaacacatgtgtgtttggggcgcgcctcttgggaccctcttgaaaaagagtcttttcacaacaaacatctttgtgatgtggaggcgccgcggggcccccaagtatgcgcataggttaaacacgtctgggccacaatcgcggtgttcccctctgaggaaacaacggggggcacgtagacaaagaggcgtggagaatttcctcacccgattaaaaag

SEQ ID NO: 304863 - DNA, 2508 bp, Homo sapiens
  misc_feature (68)..(68): n is a, c, g, or t
cgagaaagagtctcgctgcagcctcaacctcctgtgctcaagtgatccttttgcctccagcctcccangtagctaggactataagcatgtgccactatgcctagctagctttttttctttttaatttttttgcagaggtagggtctcactatgttgcccagattggtcttgaactcctggtctcaagcaatccttttgccttgacctaccaaagtattagtattacaggcatgagccaccaagcaagtccagacttttctacttcaaattaatattagtggggagggaggtgttcataatttacctctctttattatttcatttattctaacattgctacagtgacaattccatggacatacaccagctactggcggggaagatcgttcagaccagaagtggtaagaaatccttgaattttaaatatgtcataggtagttcacaaagaggacaaaagataccatttactaaacattcgccatctgttctgacataatattatcatcattgtagtctcccacttccagatacactcatctgcctatgttacacttgcctagtaaaagccagcatgggtgaatcttactattcaacggagctgaacactgtgatggagagatcatataaataaactgaatggcttatctcacatccataattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttagctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaagtaagagtactttctctttaatacaaaatgagatcatatttgtgtattatcttgcaatacaacctcctgcttgctgttgcatatattatttgcctacttcgaaaaggcagactttgtactatagtcacttgctactcaggtatgatttttgcaccgacagtatcactgtaacttgagaacatgttagaaatgtgtcatcttgggcctcgcatccaacttactaaatcaaaatctacattttaacaagatgtccaggtgactttcatgtataccaatatttggatttttttatactagtttttgagcaggcttccctatatgtgtaactatttacttactactgtattaatattcggtgattcctcactttctgagctacaaactgaggaaacaaataattttggataatgagggatagtttatgtacattacaaagcaaaaactaaaaataaaagtgtaaaatgttcgagggatttttaaatgtcttcttaattgtgatagcttcatactgtcattaccaagtatcttaaaggaccttgtttacatggggaggttcgtctatgacagaagtgtttacaaattccatatttctaaaaacctgatgtat

SEQ ID NO: 304864 - DNA, 1218 bp, Homo sapiens
caccacactgggctaattttttgtatctttagtagagactgggttttgctgtgttggccaggctggtctcgaactcctggcctcaagtgatctgcccacgccggccccacaaagtgctgggattacaggcgtgagcagctgcacctgcttaatcaattggagttctgtgtttagcagcaaacaatgagaaaatgaaatgtaaaaatatattatttacaatagcatccaacaaatgaaaatgaaatggggataaattttaaaaatatatgcaaggcttagacatggaaaactacaaaatatcgctgagagaactaaagacagcccaaataaagagagctataccgtattcatggattagaaggctcacatcactctgctcaaaatgctccctgtgtttcttgaacatgccaaacatatttgcatgtcaaatccattgtacttgttattttctctgcctggaacactctccccaaatagtcacatggcctgttcccttaccttaaggtctttgctcaaatatctctcagtgcgtcattccttgaccacctcatataagatagctcttcctcctgttcttgttcataggatttattattactaacgtcagagatttgaaattggggggaatgggtaataccctttcataagttcccccaacagaaggactttgccttattcattgccaagtgtgtagtaagtgtggtttaccctactgaaactcatgttactataatgtgaattagcttatagccaattgttaaaaagtgaatgatatcgcaataatgaggaaatcatgttgggtcatatgtgcttttccctagtgtattatgttttggtacatggtacaccatgttttggtacatggtacgtgtttttggtacatggtataccaagtacattattattacagttgattgcagcagtatgtcccagaggaatacaaaagtgtgcacatggaattcatccctcagccttgccattggtacagtttggccaagggaagtttataaggttctatgtaatttttgtacattttaccccttctttcatagttctgcagtttcagtcgttatatcccttttcatcgagttaccttcatcttttttaagggtaaaattcgatacttatggttgcttctttattaagaattcatgtatttttaatagtgctagtatttttagttttctggacaaagttgcttatgagtaactacctcaa

SEQ ID NO: 304865 - DNA, 1068 bp, Homo sapiens
atccggagtccgtgccctcttaaaaaacttttgtcttcagacatatgggtgcgtgttcatctctggccaaaactttgtttccagtttcaaagggctggttgcgaaggtggccttgtaacctttctgttgccggctctgttagttgcctgataagcagtagctaattcatcctcctcagaatttgagagtggcatctattagattcagaccaccaaggtgcctgcgcgggctctcctggttacgactgagtccccttttctcatctgtggggtgaacgcttctatttgcagaaatttgcttgcatctttttccttttatttattattactttttagagatgcggccttgctctgttgcccaggctggagtgcggtggactcttttcttttgttgatctttgccatcctctgcctggcttaatgaggttctttccctgcgtatttatgtcccaggagctcaccttccccctaggtttttaagaaggaagcagaaaatgttacaaagtataagggattctatgaagtccatagataggatttgctttgggagtagatgatttcttcttattttggtgtaaacatcaatttggatggcaattagaatgtctttagcctctttaaaaagcccttctggggcaaacctttgcaagtcactcagctggcatgtaatgagaattttatttgcatggctttttttttctaagtctctctagaagaacataaggacattctgaacatgcaaggaatacagttattctcacatcaaggatcaattttattttgtatcttcattttatgtcattttcctttattttattcacattaatctagcattaattccccccagagggaatgatatttttgcttgctgccacctgtgttattaagtgacagcttttctttatctgcttttctgaatttcatatttatatactttattgtagttttttaaaatctattctagctgggctagaatcttccaagtattaattcataatgaacttccctcttctggaattgtttaggagggctaatgttccatgttcccttcgttgctatagatatgaag

SEQ ID NO: 304866 - DNA, 2068 bp, Homo sapiens
taaaaatacagtctctcttaaagtaagtttaatctggtgttaatctttaaggcttcaactgaaaaatataaatggtgtgttatgatcaaaaatagagtgtgtatgtttctactgaaacttcagaaacataaacttagtatgacatctgcacttcagataaagttattttaaatcacgtttgagaatatatattaatacagtaattctgttcattttaaatgctaggcaatatagcgttggatttgaggttgtaacagtttctactctaggagatcctggtccccatggctttctgaggaaatctagtggtgactataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatcttgtatatagtcagaattacctaaatcacctagaggtaccgtttacatggttttgtgtatatagagttggcttgcattttaggggccattttgtataaaaagtgcatatgattaaaattagactcagtcatcactgtgagatgcctttgctaagaggataaaggaactgagaccagatgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaagtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttacggatattgcatagtttaagttagatttattgaaagatttcatctgtcgtgtttcatgtaaatgagaacagattatttgcatgaaaatatatacttcaacaaaaatctgttctttaacagagtagtggtagattattacactaatgagatttcactttggtaaatacttcatgctttcagttttagcctattaattttaggtggacaaatttaacaagttttctgttactttttaaaaagaaaaaatccagaacataagaactatattatgaacacatgatttgaacctgttgtggtaaagatcttgtacaggatgcaaactaaaaacctaatccctgccatcaaatttattagaagagacctatatatgaacaacttaaaggcactgatttctataatagagctctaaaaacatgccaccagtgtatgaataagggaaagattaattttggctggaccaatataaaaaattgtatttgaagaattgatactttaacttggaccttgaaggtaaagcttcaaaagacaggttactgaccattgagtgtttactatgtacccaatgtgtatatttttctttttaatcttcccaatagctgaataaagtatagatactatt

SEQ ID NO: 304867 - DNA, 1698 bp, Homo sapiens
tttgggttttatgcttatttccaaaccttttgtatctttaataacatacacaatggttacgcatccatatccatcacaaaagttattcataaaatgtatataaaaataacattttctttccttttaggagtgaaaagcttgagaatgtcctaaatgcgaaggacggttgagggggaggctggccatggtgtttggtaagaactgtatatagtcagaattacctaaatcacctagaggtaccgtttacatggttttgtgtatatagagttggcttgcattttaggggccattttgtataaaaagtgcatatgattaaaattagactcagtcatcactgtgagatgcctttgctaagaggataaaggaactgagaccagatgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaagtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttacggatattgcatagtttaagttagatttattgaaagatttcatctgtcgtgtttcatgtaaatgagaacagattatttgcatgaaaatatatacttcaacaaaaatctgttctttaacagagtagtggtagattattacactaatgagatttcactttggtaaatacttcatgctttcagttttagcctattaattttaggtggacaaatttaacaagttttctgttactttttaaaaagaaaaaatccagaacataagaactatattatgaacacatgatttgaacctgttgtggtaaagatcttgtacaggatgcaaactaaaaacctaatccctgccatcaaatttattagaagagacctatatatgaacaacttaaaggcactgatttctataatagagctctaaaaacatgccaccagtgtatgaataagggaaagattaattttggctggaccaatataaaaaattgtatttgaagaattgatactttaacttggaccttgaaggtaaagcttcaaaagacaggttactgaccattgagtgtttactatgtacccaatgtgtatatttttctttttaatcttcccaatagctgaataaagtatagatactatt

SEQ ID NO: 304868 - DNA, 376 bp, Homo sapiens
  misc_feature (369)..(369): n is a, c, g, or t
taaaaatacagtctctcttaaagtaagtttaatctggtgttaatctttaaggcttcaactgaaaaatataaatggtgtgttatgatcaaaaatagagtgtgtatgtttctactgaaacttcagaaacataaacttagtatgacatctgcacttcagataaagttattttaaatcacgtttgagaatatatattaatacagtaattctgttcattttaaatgctaggcaatatagcgttggatttgaggttgtaacagtttctactctaggagatcctggtccccatggctttctgaggaaatctagtggtgactataggtgtgggttttgctacctggaattagaagaaggaccttttttcttggactntaatagg

SEQ ID NO: 304869 - DNA, 3018 bp, Homo sapiens
ttcttattccaacaacaaaagtgaattatgggtttctctcatagaaaaagcatacatgaaagtcatgggaggatatgattttccaggatccaactccaatattgatcttcatgcactgactggctggataccagaaagaattgctatgcattcagatagccaaactttcagtaaggataattctttcagaatgctttatcaaagatttcacaaaggagatgtcctcatcactgcgtcaactggaatgatgacagaagctgaaggagagaagtggggtctggttcccacacacgcatatgctgttttggatattagagagttcaaggggctgcgatttatccagttgaaaaatccttggagtcatttacgttggaaaggaagatacagtgaaaatgatgtaaaaaactggactccagagttgcaaaagtatttaaactttgatccccgaacagctcagaaaatagacaacggaatattttggatttcctgggatgatctctgccagtattatgatgtgatttatttgagttggaatccaggtctttttaaagaatcaacatgtattcacagtacttgggatgctaagcaaggacctgtgaaagatgcctatagcctggccaacaacccccagtacaaactggaggtgcagtgtccacaggggggtgctgcagtttgggttttgcttagtagacacataacagacaaggatgattttgcgaataatcgagaatttatcacaatggttgtatacaagactgatgggaaaaaagtttattacccagctgacccacctccatacattgatggaattcgaattaacagccctcattatttgactaagataaagctgaccacacctggcacccatacctttacattagtggtttctcaatatgaaaaacagaacacaatccattacacggttcgggtatattcagcatgcagctttactttttcaaagattccttcaccatacaccttatcaaaacggattaatggaaagtggagtggtcagagtgctggaggatgtggaaatttccaagagactcacaaaaataaccccatctaccaattccatatagaaaagactgggccgttactgattgagctacgaggaccaaggcaatatagcgttggatttgaggttgtaacagtttctactctaggagatcctggtccccatggctttctgaggaaatctagtggtgactataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatctctaaaaacgtgttacagtggaatctggtgcttgtcagggtgtttggtaagaactgtatatagtcagaattacctaaatcacctagaggtaccgtttacatggttttgtgtatatagagttggcttgcattttaggggccattttgtataaaaagtgcatatgattaaaattagactcagtcatcactgtgagatgcctttgctaagaggataaaggaactgagaccagatgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaagtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttacggatattgcatagtttaagttagatttattgaaagatttcatctgtcgtgtttcatgtaaatgagaacagattatttgcatgaaaatatatacttcaacaaaaatctgttctttaacagagtagtggtagattattacactaatgagatttcactttggtaaatacttcatgctttcagttttagcctattaattttaggtggacaaatttaacaagttttctgttactttttaaaaagaaaaaatccagaacataagaactatattatgaacacatgatttgaacctgttgtggtaaagatcttgtacaggatgcaaactaaaaacctaatccctgccatcaaatttattagaagagacctatatatgaacaacttaaaggcactgatttctataatagagctctaaaaacatgccaccagtgtatgaataagggaaagattaattttggctggaccaatataaaaaattgtatttgaagaattgatactttaacttggaccttgaaggtaaagcttcaaaagacaggttactgaccattgagtgtttactatgtacccaatgtgtatatttttctttttaatcttcccaatagctgaataaagtatagatactatt

SEQ ID NO: 304870 - DNA, 2872 bp, Homo sapiens
ttcttattccaacaacaaaagtgaattatgggtttctctcatagaaaaagcatacatgaaagtcatgggaggatatgattttccaggatccaactccaatattgatcttcatgcactgactggctggataccagaaagaattgctatgcattcagatagccaaactttcagtaaggataattctttcagaatgctttatcaaagatttcacaaaggagatgtcctcatcactgcgtcaactggaatgatgacagaagctgaaggagagaagtggggtctggttcccacacacgcatatgctgttttggatattagagagttcaaggggctgcgatttatccagttgaaaaatccttggagtcatttacgttggaaaggaagatacagtgaaaatgatgtaaaaaactggactccagagttgcaaaagtatttaaactttgatccccgaacagctcagaaaatagacaacggaatattttggatttcctgggatgatctctgccagtattatgatgtgatttatttgagttggaatccaggtctttttaaagaatcaacatgtattcacagtacttgggatgctaagcaaggacctgtgaaagatgcctatagcctggccaacaacccccagtacaaactggaggtgcagtgtccacaggggggtgctgcagtttgggttttgcttagtagacacataacagacaaggatgattttgcgaataatcgagaatttatcacaatggttgtatacaagactgatgggaaaaaagtttattacccaggtatattcagcatgcagctttactttttcaaagattccttcaccatacaccttatcaaaacggattaatggaaagtggagtggtcagagtgctggaggatgtggaaatttccaagagactcacaaaaataaccccatctaccaattccatatagaaaagactgggccgttactgattgagctacgaggaccaaggcaatatagcgttggatttgaggttgtaacagtttctactctaggagatcctggtccccatggctttctgaggaaatctagtggtgactataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatctctaaaaacgtgttacagtggaatctggtgcttgtcagggtgtttggtaagaactgtatatagtcagaattacctaaatcacctagaggtaccgtttacatggttttgtgtatatagagttggcttgcattttaggggccattttgtataaaaagtgcatatgattaaaattagactcagtcatcactgtgagatgcctttgctaagaggataaaggaactgagaccagatgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaagtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttacggatattgcatagtttaagttagatttattgaaagatttcatctgtcgtgtttcatgtaaatgagaacagattatttgcatgaaaatatatacttcaacaaaaatctgttctttaacagagtagtggtagattattacactaatgagatttcactttggtaaatacttcatgctttcagttttagcctattaattttaggtggacaaatttaacaagttttctgttactttttaaaaagaaaaaatccagaacataagaactatattatgaacacatgatttgaacctgttgtggtaaagatcttgtacaggatgcaaactaaaaacctaatccctgccatcaaatttattagaagagacctatatatgaacaacttaaaggcactgatttctataatagagctctaaaaacatgccaccagtgtatgaataagggaaagattaattttggctggaccaatataaaaaattgtatttgaagaattgatactttaacttggaccttgaaggtaaagcttcaaaagacaggttactgaccattgagtgtttactatgtacccaatgtgtatatttttctttttaatcttcccaatagctgaataaagtatagatactatt

SEQ ID NO: 304871 - DNA, 2180 bp, Homo sapiens
tgatttttttagtcttccaatatattcatgtatcactttgatgttcttgtaagtgtaaaatttatcaatacagtctttttttaaatctaggtatattcagcatgcagctttactttttcaaagattccttcaccatacaccttatcaaaacggattaatggaaagtggagtggtcagagtgctggaggatgtggaaatttccaagagactcacaaaaataaccccatctaccaattccatatagaaaagactgggccgttactgattgagctacgaggaccaaggcaatatagcgttggatttgaggttgtaacagtttctactctaggagatcctggtccccatggctttctgaggaaatctagtggtgactataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatctctaaaaacgtgttacagtggaatctggtgcttgtcagggtgtttggtaagaactgtatatagtcagaattacctaaatcacctagaggtaccgtttacatggttttgtgtatatagagttggcttgcattttaggggccattttgtataaaaagtgcatatgattaaaattagactcagtcatcactgtgagatgcctttgctaagaggataaaggaactgagaccagatgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaagtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttacggatattgcatagtttaagttagatttattgaaagatttcatctgtcgtgtttcatgtaaatgagaacagattatttgcatgaaaatatatacttcaacaaaaatctgttctttaacagagtagtggtagattattacactaatgagatttcactttggtaaatacttcatgctttcagttttagcctattaattttaggtggacaaatttaacaagttttctgttactttttaaaaagaaaaaatccagaacataagaactatattatgaacacatgatttgaacctgttgtggtaaagatcttgtacaggatgcaaactaaaaacctaatccctgccatcaaatttattagaagagacctatatatgaacaacttaaaggcactgatttctataatagagctctaaaaacatgccaccagtgtatgaataagggaaagattaattttggctggaccaatataaaaaattgtatttgaagaattgatactttaacttggaccttgaaggtaaagcttcaaaagacaggttactgaccattgagtgtttactatgtacccaatgtgtatatttttctttttaatcttcccaatagctgaataaagtatagatactatt

SEQ ID NO: 304872 - DNA, 2105 bp, Homo sapiens
tgagatggaaaggagttttgtctttaagtggaattggaaatgaaattttgttaatactaaaacttttgtttttattagattaatggaaagtggagtggtcagagtgctggaggatgtggaaatttccaagagactcacaaaaataaccccatctaccaattccatatagaaaagactgggccgttactgattgagctacgaggaccaaggcaatatagcgttggatttgaggttgtaacagtttctactctaggagatcctggtccccatggctttctgaggaaatctagtggtgactataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatctctaaaaacgtgttacagtggaatctggtgcttgtcagggtgtttggtaagaactgtatatagtcagaattacctaaatcacctagaggtaccgtttacatggttttgtgtatatagagttggcttgcattttaggggccattttgtataaaaagtgcatatgattaaaattagactcagtcatcactgtgagatgcctttgctaagaggataaaggaactgagaccagatgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaagtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttacggatattgcatagtttaagttagatttattgaaagatttcatctgtcgtgtttcatgtaaatgagaacagattatttgcatgaaaatatatacttcaacaaaaatctgttctttaacagagtagtggtagattattacactaatgagatttcactttggtaaatacttcatgctttcagttttagcctattaattttaggtggacaaatttaacaagttttctgttactttttaaaaagaaaaaatccagaacataagaactatattatgaacacatgatttgaacctgttgtggtaaagatcttgtacaggatgcaaactaaaaacctaatccctgccatcaaatttattagaagagacctatatatgaacaacttaaaggcactgatttctataatagagctctaaaaacatgccaccagtgtatgaataagggaaagattaattttggctggaccaatataaaaaattgtatttgaagaattgatactttaacttggaccttgaaggtaaagcttcaaaagacaggttactgaccattgagtgtttactatgtacccaatgtgtatatttttctttttaatcttcccaatagctgaataaagtatagatactatt

SEQ ID NO: 304873 - DNA, 2838 bp, Homo sapiens
ttcttattccaacaacaaaagtgaattatgggtttctctcatagaaaaagcatacatgaaagtcatgggaggatatgattttccaggatccaactccaatattgatcttcatgcactgactggctggataccagaaagaattgctatgcattcagatagccaaactttcagtaaggataattctttcagaatgctttatcaaagatttcacaaaggagatgtcctcatcactgcgtcaactggaatgatgacagaagctgaaggagagaagtggggtctggttcccacacacgcatatgctgttttggatattagagagttcaaggggctgcgatttatccagttgaaaaatccttggagtcatttacgttggaaaggaagatacagtgaaaatgatgtaaaaaactggactccagagttgcaaaagtatttaaactttgatccccgaacagctcagaaaatagacaacggaatattttggatttcctgggatgatctctgccagtattatgatgtgatttatttgagttggaatccaggtctttttaaagaatcaacatgtattcacaggatgattttgcgaataatcgagaatttatcacaatggttgtatacaagactgatgggaaaaaagtttattacccagctgacccacctccatacattgatggaattcgaattaacagccctcattatttgactaagataaagctgaccacacctggcacccatacctttacattagtggtttctcaatatgaaaaacagaacacaatccattacacggttcgggtatattcagcatgcagctttactttttcaaagattccttcaccatacaccttatcaaaacggattaatggaaagtggagtggtcagagtgctggaggatgtggaaatttccaagagactcacaaaaataaccccatctaccaattccatatagaaaagactgggccgttactgattgagctacgaggaccaaggagatcctggtccccatggctttctgaggaaatctagtggtgactataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatctctaaaaacgtgttacagtggaatctggtgcttgtcagggtgtttggtaagaactgtatatagtcagaattacctaaatcacctagaggtaccgtttacatggttttgtgtatatagagttggcttgcattttaggggccattttgtataaaaagtgcatatgattaaaattagactcagtcatcactgtgagatgcctttgctaagaggataaaggaactgagaccagatgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaagtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttacggatattgcatagtttaagttagatttattgaaagatttcatctgtcgtgtttcatgtaaatgagaacagattatttgcatgaaaatatatacttcaacaaaaatctgttctttaacagagtagtggtagattattacactaatgagatttcactttggtaaatacttcatgctttcagttttagcctattaattttaggtggacaaatttaacaagttttctgttactttttaaaaagaaaaaatccagaacataagaactatattatgaacacatgatttgaacctgttgtggtaaagatcttgtacaggatgcaaactaaaaacctaatccctgccatcaaatttattagaagagacctatatatgaacaacttaaaggcactgatttctataatagagctctaaaaacatgccaccagtgtatgaataagggaaagattaattttggctggaccaatataaaaaattgtatttgaagaattgatactttaacttggaccttgaaggtaaagcttcaaaagacaggttactgaccattgagtgtttactatgtacccaatgtgtatatttttctttttaatcttcccaatagctgaataaagtatagatactatt

SEQ ID NO: 304874 - DNA, 1538 bp, Homo sapiens
ttcttattccaacaacaaaagtgaattatgggtttctctcatagaaaaagcatacatgaaagtcatgggaggatatgattttccaggatccaactccaatattgatcttcatgcactgactggctggataccagaaagaattgctatgcattcagatagccaaactttcagtaaggataattctttcagaatgctttatcaaagatttcacaaaggagatgtcctcatcactgcgtcaactggaatgatgacagaagctgaaggagagaagtggggtctggttcccacacacgcatatgctgttttggatattagagagttcaaggggctgcgatttatccagttgaaaaatccttggagtcatttacgttggaaaggaagatacagtgaaaatgatgtaaaaaactggactccagagttgcaaaagtatttaaactttgatccccgaacagctcagaaaatagacaacggaatattttggatttcctgggatgatctctgccagtattatgatgtgatttatttgagttggaatccaggtctttttaaagaatcaacatgtattcacagtacttgggatgctaagcaaggacctgtgaaagatgcctatagcctggccaacaacccccagtacaaactggaggtgcagtgtccacaggggggtgctgcagtttgggttttgcttagtagacacataacagacaaggatgattttgcgaataatcgagaatttatcacaatggttgtatacaagactgatgggaaaaaagtttattacccagctgacccacctccatacattgatggaattcgaattaacagccctcattatttgactaagataaagctgaccacacctggcacccatacctttacattagtggtttctcaatatgaaaaacagaacacaatccattacacggttcgggtatattcagcatgcagctttactttttcaaagattccttcaccatacaccttatcaaaacggattaatggaaagtggagtggtcagagtgctggaggatgtggaaatttccaagagactcacaaaaataaccccatctaccaattccatatagaaaagactgggccgttactgattgagctacgaggaccaaggcaatatagcgttggatttgaggttgtaacagtttctactctaggagatcctggtccccatggctttctgaggaaatctagtggtgactataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacaggtaacaggcttaccgtttccgggaaaggctaagactggttactggctggcaaagggaatccatcaaggttatcccatccacttcgttggagccctggtcc

SEQ ID NO: 304875 - DNA, 1424 bp, Homo sapiens
ttcttattccaacaacaaaagtgaattatgggtttctctcatagaaaaagcatacatgaaagtcatgggaggatatgattttccaggatccaactccaatattgatcttcatgcactgactggctggataccagaaagaattgctatgcattcagatagccaaactttcagtaaggataattctttcagaatgctttatcaaagatttcacaaaggagatgtcctcatcactgcgtcaactggaatgatgacagaagctgaaggagagaagtggggtctggttcccacacacgcatatgctgttttggatattagagagttcaaggggctgcgatttatccagttgaaaaatccttggagtcatttacgttggaaaggaagatacagtgaaaatgatgtaaaaaactggactccagagttgcaaaagtatttaaactttgatccccgaacagctcagaaaatagacaacggaatattttggatttcctgggatgatctctgccagtattatgatgtgatttatttgagttggaatccaggtctttttaaagaatcaacatgtattcacagtacttgggatgctaagcaaggacctgtgaaagatgcctatagcctggccaacaacccccagtacaaactggaggtgcagtgtccacaggggggtgctgcagtttgggttttgcttagtagacacataacagacaaggatgattttgcgaataatcgagaatttatcacaatggttgtatacaagactgatgggaaaaaagtttattacccagctgacccacctccatacattgatggaattcgaattaacagccctcattatttgactaagataaagctgaccacacctggcacccatacctttacattagtggtttctcaatatgaaaaacagaacacaatccattacacggttcgggtatattcagcatgcagctttactttttcaaagattccttcaccatacaccttatcaaaacggattaatggaaagtggagtggtcagagtgctggaggatgtggaaatttccaagagactcacaaaaataaccccatctaccaattccatatagaaaagactgggccgttactgattgagctacgaggaccaaggcaatatagcgttggatttgaggttgtaacagtttctactctaggagatcctggtccccatggctttctgaggaaatctagtggtgactataggtgtgggttttgctacctggaattagaaaatataccttctgggatcttcaatatcattcctagtacctttttgcctaaacaagaaggaccttttttcttggactttaatagtattatcgctcaccgcggtctcgtggtcatcactacttcgctgccagtacgctttgctgctaacgctcttgcctggtacacgctgtttcctggtaaag

SEQ ID NO: 304876 - DNA, 708 bp, Homo sapiens
ttcttattccaacaacaaaagtgaattatgggtttctctcatagaaaaagcatacatgaaagtcatgggaggatatgattttccaggatccaactccaatattgatcttcatgcactgactggctggataccagaaagaattgctatgcattcagatagccaaactttcagtaaggataattctttcagaatgctttatcaaagatttcacaaaggagatgtcctcatcactgcgtcaactggaatgatgacagaagctgaaggagagaagtggggtctggttcccacacacgcatatgctgttttggatattagagagttcaaggggctgcgatttatccagttgaaaaatccttggagtcatttacgttggaaaggaagatacagtgaaaatgatgtaaaaaactggactccagagttgcaaaagtatttaaactttgatccccgaacagctcagaaaatagacaacggaatattttggatttcctgggatgatctctgccagtattatgatgtgatttatttgagttggaatccaggtctttttaaagaatcaacatgtattcacaggtaactttttgcacattgcagagtatgctttataatagcatccactctgcctcccaaagtgctgggattacaggcgtgagccaccgcgcctggccaatgacaatatttttaattataccctgtggccaggcgtggtgg

SEQ ID NO: 304877 - DNA, 513 bp, Homo sapiens
agcatacatgaaagtcatgggaggatatgattttccaggatccaactccgtaagtaatagataagacgatccagacacagatttaagctatctaatataactgttttaaatttgaaaaattctagatagtctttttgtttatagggaaagagagcagattatcaacccctgaaacaggatgaccagtccccgtattatggggatatatatattttcttgtgtatccgggaaagcctaaactgtgtctgcttttgttgggatacaaggccaattataaatacagtgtacatttccagagcagtctgtttagatcaaatggatgtgtcatattgtcatgtatttttttatttgtaattcaggttcaaggagttacttgttttatccagtcttaacagaacttaacctataagattgaggtgtcttccagtgaccttttgttgcatgaggtaaactagacttgagccagaaagaaattagtcagattggcatgactttaaattcttacaataacca

SEQ ID NO: 304878 - DNA, 386 bp, Homo sapiens
tctgtctcaaaaaaataaataaataacggaatggttaatttaggaagactagcattccatctttttgtcacgcccacagtgactatcttgttaatagttgttttctttccatgcttcctagttatgccaaaaaaatttaaaaacagtaaaacaaaaccaaaaacttggatagcttaattcactttttgaaatagtgttatattttagctctatgagaaatttaattacaaccttctttgttgactttatcttttagtacttgggatgctaagcaaggacctgtgaaagatgcctatagcctggccaacaacccccagtacaaactggaggtgcagtgtccacaggggggtgctgcagtttgggttttgcttagtagacacataaca

SEQ ID NO: 304879 - DNA, 5666 bp, Homo sapiens
aacttctctccgtaaaagatgttgcccacttgccatttctaggccaggaggaagagattggaactctggagagtctttcttgttttgtctcagggtgtctttacatttggcaatctccgtcctacagagggctggaaaagccctgcgggagacggcatatccaccacccgctgctgggtcggccctgcagctgtgtgcacccgagaactgccaaagaagctgggtcttggcgcggcgggacgggccaatcagaagaagtttggccctctgcagtttccgtccgctcactaggaggcgctgcggcagcgacggcggcgtcggcggcggccggggctgtcgcgggttggggcggttgggctggcagctgaggctcgtggccatggagtggggttctgagtcggctgctgtgaggcggcaccgcgtcggagtagagcgtcgagagggagcggcggccgcgccaccgccggagagggaggcccgagcgcaggagcctctggtggatgggtgcagcggcggcgggaggacgcggaagaggagccccgggggtagcggcggcgcgagcaggggcgcggggaccgggctgtctgaggtgcgcgccgcgctggggctcgcgctctacctgatcgcgctgcggacgctggtgcagctctcgctgcagcagctcgtgctacgcggggccgctggacaccgcggggagttcgacgcgctccaagccagggattatcttgaacacataacctccattggccccaggactacaggaagtccagaaaatgaaattctgaccgtgcactaccttttggaacagattaaactgattgaagtgcaaagcaacagccttcataagatttcagtagatgtacaacggcccacaggctcttttagcattgatttcttgggaggttttacaagctattatgacaacatcaccaatgttgtggtaaagctggaacccagagatggagcccagcatgctgtcttggctaattgtcattttgactcagtagcaaactcaccaggtgccagtgatgatgcagttagctgctcagtgatgctggaagtccttcgcgtcttgtcaacatcttcagaagccttgcatcatgctgtcatatttctctttaatggtgctgaggaaaatgtcttgcaagccagtcatggtttcattactcagcacccctgggctagcttgattcgtgcattcattaacctagaggcagcaggtgtaggagggaaagaacttgtattccaaacaggtcctgaaaatccttggttggttcaagcttatgtttcagcagctaaacacccttttgcttctgtggtggctcaggaggtttttcagagtggaatcattccttcagatactgactttcgtatctacagggattttgggaacattccaggaatagacttagcttttattgagaatggatacatttatcacaccaagtatgacacagcggacagaattctaacagattccattcagagagcaggtgacaacattttagcagttcttaagcatctagctacatctgatatgctggctgctgcttctaagtatcgacatggaaacatggtcttctttgatgtgctgggcctgtttgtcattgcctacccctctcgtattggctcaatcataaactacatggtggtaatgggtgttgttttgtacctgggcaaaaaatttttgcagcccaaacataagactggtaactacaagaaggacttcttgtgtggacttggcatcactttgatcagctggttcactagccttgttaccgttctcattatagcagtgttcatctctcttattggacagtctctctcatggtataaccacttctatgtctccgtttgtctgtatggaactgcaactgtagccaaaataatacttatacatactcttgcgaaaagattttattacatgaatgccagtgcccagtatctgggagaagtattttttgacatttcgctgtttgtccattgctgttttcttgttaccctcacttaccaaggactttgctcggcgtttattagtgctgtctgggtagcattcccattgctcacaaagctctgtgtgcataaggacttcaagcagcatggtgcccaaggaaaatttattgctttttaccttttggggatgtttattccttatctttatgcattgtacctcatctgggcagtatttgagatgtttacccctatcctcgggagaagtggttctgaaatcccacctgatgttgtgctggcatccattttggctggctgtacaatgattctctcgtcctattttattaacttcatctaccttgccaagagcacaaaaaaaaccatgctaactttaactttggtatgtgcaattacattcctccttgtttgcagtggaacattttttccatatagctccaatcctgctaatccgaagccaaagagagtgtttcttcagcatatgactagaacattccatgacttggaaggaaatgcagttaaacgggactctggaatatggatcaatgggtttgattatactggaatttctcacataacccctcacattcctgagatcaatgatagtatccgagctcactgtgaggagaatgcacctctttgtggttttccttggtatcttccagtgcactttctgatcaggaaaaactggtatcttcctgccccagaagtttctccaagaaatcctcctcatttccgactcatatccaaagaacagacaccttgggattctataaaattgacttttgaagcaacaggaccaagccatatgtccttctatgttcgagcccacaaagggtcaacactttctcagtggtctcttggcaatggcaccccagtcacaagtaaaggaggagactactttgtcttttactcccatggactccaggcctctgcatggcagttctggatagaagtgcaggtttcagaagaacatcctgaaggaatggtcaccgtggccattgctgcccactatctgtctggggaagacaagagatcccctcaactggatgctctgaaggaaaagttcccagattggacatttccctctgcctgggtgtgcacctacgatctctttgtattttaatcttgtggatgagctctaagtacatgcccagtggatactccatgtgacatggtttctccctatgttacgtggatgtttgtaacgtaagtcaatgaattttaatgatcatatgttcaaagagctttctgggttaacgcttttcagggccaagcactataagggtttagctgtggcgcagtgatgcatggcctgttgacacttgaaaatgccagtcttttggcacttcagcacatgtgggtactgccactacacacacgtcattttatatgaccttaaggacaaagccaacaatccacttcaatagctgcccctttaggatcaagaaagatgtacactgtcagagcattgttaatgagacaaaagttgtttccaatttaagccccaaaaccatttgttgtattagtggatggtgggtaaaatatcattcactgaggtaatgattccccttgagaatataactctgtgtaggtcactggaaagtgattgccatagggctgggagagaagcattgcactcttgaggctgtagcctgtgtcaagctgtttcttcaggcagcctctcaaatgtgctttgtctctctgtgctgaggcctggaccctgtgctgagctggtgactcactgtcctgacaagtggacacacagatgcactgctgtgctgctttcctgaggtggttttctatgcctgttttcctctgaaacatgtctgttacccctctccatcttaccaagttgaaaaggggaatatttggccacatacccctctggttttcgtaggttcttttggttcagaatattgtttgtgccagtacatgaccttaacttccttcctcagagcactgagctgccatctgggctattctggggtagaaggaaggctgggagtggtgggaattttataaatatttattctcttttctttgtttcataggagtcttgtgttatacaaggttagtccttcatggtataatcttactgatgcactgggcctatctttttgttttccagccagttgaatagattagtttttctcagtaacttactatccagcagactggctttcctgagacttgaggttgtggcttatactggaatgagaccactgtacgtgtaggtggttcagatcctgcgtaatggcagcatgaggacttaaaaggtggttttcattttgaagatggctatgtagcttgtaaggtgtatcacagcagtacctctcatggctttttggttccagcagtgagggcattggtgagatcaatggtaaactgtgcaagctttctttttatcattaggaaatgtgaaacgttggacaaattttgagttttaacaaggacaaaaagttgaaagaaaaggcacagttaacaaaaaagggtggctagatttatcttgggtgatggaggaaatgagagaggaatgctcttgaaaggtggtctgtggatctgtctgaatagaaagagcacagtaagtatgcattgccggagaaaacgtccttgaagctgcttgtctcatgtgtatgatgtgctttttaaatcatgcccctcgttgcctgcctaatctgtgactccctaaaaactaactgggcccatgtagatggggctgcaaccagagctgaataacatgttaggctcacacatgcatcagcactgcacactggaatcattgctcttcctggactttgtagaaatcagtctcaagtgcttcaagagtctggctcctgctacttttatctgtcaggtagcacataaggtttgcagggtttatattttgtatagaatcacagttgtggagaaaaagtaataatttctcaatgaattttaaaaatgggcctattttctatccccgtggttcatctgatataattagtgttccctgtgaattccccccctctatgggaaggatgcctttactctttatcagtaataaattatgactgttttcatattgccttagggttatttccctgtgtaaaccattgtcttttgttttggttttctttagcattatgaagctttggtattgtacaaggtcagtagtaagatgctcactagtctcagggcttgtgtaatattctgggaggtcatttaaatgccagaaatggtcaagcaattatacacagtatttatgactctgttaagcataccgtttgtctgtcacattagtagattctgagattaaaaaaaatttttaaagagtgatcatttaaataatttctaaaagggtcttttcaagctctaacaaagtcactaacaaatgcattattttctacagaattagatgttagtagtacagtactgcatattcagggaaaaagtgtgaggaattgatttcaaaatagttcgttcttgtgtttgacctaagaatgattgtcgcatgaagtgtttgtttttacagtttagcatatataaacaaacatgataggattccttaagatgttaccacccagggggccacaagccagcctgctgtctcaggaagctgtagaaggagtgtttgtcaatttcttgtcactggtttgctgacttactgaggattaattgttgccttacaatgttactgaaataaactgtttaatata

SEQ ID NO: 304880 - DNA, 5902 bp, Homo sapiens
aacttctctccgtaaaagatgttgcccacttgccatttctaggccaggaggaagagattggaactctggagagtctttcttgttttgtctcagggtgtctttacatttggcaatctccgtcctacagagggctggaaaagccctgcgggagacggcatatccaccacccgctgctgggtcggccctgcagctgtgtgcacccgagaactgccaaagaagctgggtcttggcgcggcgggacgggccaatcagaagaagtttggccctctgcagtttccgtccgctcactaggaggcgctgcggcagcgacggcggcgtcggcggcggccggggctgtcgcgggttggggcggttgggctggcagctgaggctcgtggccatggagtggggttctgagtcggctgctgtgaggcggcaccgcgtcggagtagagcgtcgagagggagcggcggccgcgccaccgccggagagggaggcccgagcgcaggagcctctggtggatgggtgcagcggcggcgggaggacgcggaagaggagccccgggggtagcggcggcgcgagcaggggcgcggggaccgggctgtctgaggtgcgcgccgcgctggggctcgcgctctacctgatcgcgctgcggacgctggtgcagctctcgctgcagcagctcgtgctacgcggggccgctggacaccgcggggagttcgacgcgctccaagccaggtaccggccgctccctcctggcacggcccgcgcgtccgtttgcggctcctgcgcaggctccggggcaccgcacctgtgtgcacccgcccctgccggaccgctgggactcgctgacccctcccaggctgcacgtggggtggggtgaccttgcttgtccttcttctggggtctgaattgccgggacttggggcttgcctgtccccggttaagctcgtggtgcagattggggttgccagggattatcttgaacacataacctccattggccccaggactacaggaagtccagaaaatgaaattctgaccgtgcactaccttttggaacagattaaactgattgaagtgcaaagcaacagccttcataagatttcagtagatgtacaacggcccacaggctcttttagcattgatttcttgggaggttttacaagctattatgacaacatcaccaatgttgtggtaaagctggaacccagagatggagcccagcatgctgtcttggctaattgtcattttgactcagtagcaaactcaccaggtgccagtgatgatgcagttagctgctcagtgatgctggaagtccttcgcgtcttgtcaacatcttcagaagccttgcatcatgctgtcatatttctctttaatggtgctgaggaaaatgtcttgcaagccagtcatggtttcattactcagcacccctgggctagcttgattcgtgcattcattaacctagaggcagcaggtgtaggagggaaagaacttgtattccaaacaggtcctgaaaatccttggttggttcaagcttatgtttcagcagctaaacacccttttgcttctgtggtggctcaggaggtttttcagagtggaatcattccttcagatactgactttcgtatctacagggattttgggaacattccaggaatagacttagcttttattgagaatggatacatttatcacaccaagtatgacacagcggacagaattctaacagattccattcagagagcaggtgacaacattttagcagttcttaagcatctagctacatctgatatgctggctgctgcttctaagtatcgacatggaaacatggtcttctttgatgtgctgggcctgtttgtcattgcctacccctctcgtattggctcaatcataaactacatggtggtaatgggtgttgttttgtacctgggcaaaaaatttttgcagcccaaacataagactggtaactacaagaaggacttcttgtgtggacttggcatcactttgatcagctggttcactagccttgttaccgttctcattatagcagtgttcatctctcttattggacagtctctctcatggtataaccacttctatgtctccgtttgtctgtatggaactgcaactgtagccaaaataatacttatacatactcttgcgaaaagattttattacatgaatgccagtgcccagtatctgggagaagtattttttgacatttcgctgtttgtccattgctgttttcttgttaccctcacttaccaaggactttgctcggcgtttattagtgctgtctgggtagcattcccattgctcacaaagctctgtgtgcataaggacttcaagcagcatggtgcccaaggaaaatttattgctttttaccttttggggatgtttattccttatctttatgcattgtacctcatctgggcagtatttgagatgtttacccctatcctcgggagaagtggttctgaaatcccacctgatgttgtgctggcatccattttggctggctgtacaatgattctctcgtcctattttattaacttcatctaccttgccaagagcacaaaaaaaaccatgctaactttaactttggtatgtgcaattacattcctccttgtttgcagtggaacattttttccatatagctccaatcctgctaatccgaagccaaagagagtgtttcttcagcatatgactagaacattccatgacttggaaggaaatgcagttaaacgggactctggaatatggatcaatgggtttgattatactggaatttctcacataacccctcacattcctgagatcaatgatagtatccgagctcactgtgaggagaatgcacctctttgtggttttccttggtatcttccagtgcactttctgatcaggaaaaactggtatcttcctgccccagaagtttctccaagaaatcctcctcatttccgactcatatccaaagaacagacaccttgggattctataaaattgacttttgaagcaacaggaccaagccatatgtccttctatgttcgagcccacaaagggtcaacactttctcagtggtctcttggcaatggcaccccagtcacaagtaaaggaggagactactttgtcttttactcccatggactccaggcctctgcatggcagttctggatagaagtgcaggtttcagaagaacatcctgaaggaatggtcaccgtggccattgctgcccactatctgtctggggaagacaagagatcccctcaactggatgctctgaaggaaaagttcccagattggacatttccctctgcctgggtgtgcacctacgatctctttgtattttaatcttgtggatgagctctaagtacatgcccagtggatactccatgtgacatggtttctccctatgttacgtggatgtttgtaacgtaagtcaatgaattttaatgatcatatgttcaaagagctttctgggttaacgcttttcagggccaagcactataagggtttagctgtggcgcagtgatgcatggcctgttgacacttgaaaatgccagtcttttggcacttcagcacatgtgggtactgccactacacacacgtcattttatatgaccttaaggacaaagccaacaatccacttcaatagctgcccctttaggatcaagaaagatgtacactgtcagagcattgttaatgagacaaaagttgtttccaatttaagccccaaaaccatttgttgtattagtggatggtgggtaaaatatcattcactgaggtaatgattccccttgagaatataactctgtgtaggtcactggaaagtgattgccatagggctgggagagaagcattgcactcttgaggctgtagcctgtgtcaagctgtttcttcaggcagcctctcaaatgtgctttgtctctctgtgctgaggcctggaccctgtgctgagctggtgactcactgtcctgacaagtggacacacagatgcactgctgtgctgctttcctgaggtggttttctatgcctgttttcctctgaaacatgtctgttacccctctccatcttaccaagttgaaaaggggaatatttggccacatacccctctggttttcgtaggttcttttggttcagaatattgtttgtgccagtacatgaccttaacttccttcctcagagcactgagctgccatctgggctattctggggtagaaggaaggctgggagtggtgggaattttataaatatttattctcttttctttgtttcataggagtcttgtgttatacaaggttagtccttcatggtataatcttactgatgcactgggcctatctttttgttttccagccagttgaatagattagtttttctcagtaacttactatccagcagactggctttcctgagacttgaggttgtggcttatactggaatgagaccactgtacgtgtaggtggttcagatcctgcgtaatggcagcatgaggacttaaaaggtggttttcattttgaagatggctatgtagcttgtaaggtgtatcacagcagtacctctcatggctttttggttccagcagtgagggcattggtgagatcaatggtaaactgtgcaagctttctttttatcattaggaaatgtgaaacgttggacaaattttgagttttaacaaggacaaaaagttgaaagaaaaggcacagttaacaaaaaagggtggctagatttatcttgggtgatggaggaaatgagagaggaatgctcttgaaaggtggtctgtggatctgtctgaatagaaagagcacagtaagtatgcattgccggagaaaacgtccttgaagctgcttgtctcatgtgtatgatgtgctttttaaatcatgcccctcgttgcctgcctaatctgtgactccctaaaaactaactgggcccatgtagatggggctgcaaccagagctgaataacatgttaggctcacacatgcatcagcactgcacactggaatcattgctcttcctggactttgtagaaatcagtctcaagtgcttcaagagtctggctcctgctacttttatctgtcaggtagcacataaggtttgcagggtttatattttgtatagaatcacagttgtggagaaaaagtaataatttctcaatgaattttaaaaatgggcctattttctatccccgtggttcatctgatataattagtgttccctgtgaattccccccctctatgggaaggatgcctttactctttatcagtaataaattatgactgttttcatattgccttagggttatttccctgtgtaaaccattgtcttttgttttggttttctttagcattatgaagctttggtattgtacaaggtcagtagtaagatgctcactagtctcagggcttgtgtaatattctgggaggtcatttaaatgccagaaatggtcaagcaattatacacagtatttatgactctgttaagcataccgtttgtctgtcacattagtagattctgagattaaaaaaaatttttaaagagtgatcatttaaataatttctaaaagggtcttttcaagctctaacaaagtcactaacaaatgcattattttctacagaattagatgttagtagtacagtactgcatattcagggaaaaagtgtgaggaattgatttcaaaatagttcgttcttgtgtttgacctaagaatgattgtcgcatgaagtgtttgtttttacagtttagcatatataaacaaacatgataggattccttaagatgttaccacccagggggccacaagccagcctgctgtctcaggaagctgtagaaggagtgtttgtcaatttcttgtcactggtttgctgacttactgaggattaattgttgccttacaatgttactgaaataaactgtttaatata

SEQ ID NO: 304881 - DNA, 5045 bp, Homo sapiens
aacttctctccgtaaaagatgttgcccacttgccatttctaggccaggaggaagagattggaactctggagagtctttcttgttttgtctcagggtgtctttacatttggcaatctccgtcctacagagggctggaaaagccctgcgggagacggcatatccaccacccgctgctgggtcggccctgcagctgtgtgcacccgagaactgccaaagaagctgggtcttggcgcggcgggacgggccaatcagaagaagtttggccctctgcagtttccgtccgctcactaggaggcgctgcggcagcgacggcggcgtcggcggcggccggggctgtcgcgggttggggcggttgggctggcagctgaggctcgtggccatggagtggggttctgagtcggctgctgtgaggcggcaccgcgtcggagtagagcgtcgagagggagcggcggccgcgccaccgccggagagggaggcccgagcgcaggagcctctggtggatgggtgcagcggcggcgggaggacgcggaagaggagccccgggggtagcggcggcgcgagcaggggcgcggggaccgggctgtctgaggtgcgcgccgcgctggggctcgcgctctacctgatcgcgctgcggacgctggtgcagctctcgctgcagcagctcgtgctacgcggggccgctggacaccgcggggagttcgacgcgctccaagccagggattatcttgaacacataacctccattggccccaggactacaggaagtccagaaaatgaaattctgaccgtgcactaccttttggaacagattaaactgattgaagtgcaaagcaacagccttcataagatttcagtagatgtacaacggcccacaggctcttttagcattgatttcttgggaggttttacaagctattatgacaacatcaccaatgttgtggtaaagctggaacccagagatggagcccagcatgctgtcttggctaattgtcattttgactcagtagcaaactcaccaggtgccagtgatgatgcagttagctgctcagtgatgctggaagtccttcgcgtcttgtcaacatcttcagaagccttgcatcatgctgtcatatttctctttaatggtgctgaggaaaatgtcttgcaagccagtcatggtttcattactcagcacccctgggctagcttgattcgtgcattcattaacctagaggcagcaggtgtaggagggaaagaacttgtattccaaacaggtcctgaaaatccttggttggttcaagcttatgtttcagcagctaaacacccttttgcttctgtggtggctcaggaggtttttcagagtggaatcattccttcagatactgactttcgtatctacagggattttgggaacattccaggaatagacttagcttttattgagaatggatacatttatcacaccaagtatgacacagcggacagaattctaacagattccattcagagagcaggtgacaacattttagcagttcttaagcatctagctacatctgatatgctggctgctgcttctaagtatcgacatggaaacatggtcttctttgatgtgctgggcctgtttgtcattgcctacccctctcgtattggctcaatcataaactacatggtggtaatgggtgttgttttgtacctgggcaaaaaatttttgcagcccaaacataagactggtaactacaagaaggacttcttgtgtggacttggcatcactttgatcagctggttcactagccttgttaccgttctcattatagcagtgttcatctctcttattggacagtctctctcatggtataaccacttctatgtctccgtttgtctgtatggaactgcaactgtagccaaaataatacttatacatactcttgcgaaaagattttattacatgaatgccagtgcccagtatctgggagaagtattttttgacatttcgctgtttgtccattgctgttttcttgttaccctcacttaccaaggactttgctcggcgtttattagtgctgtctgggtagcattcccattgctcacaaagctctgtgtgcataaggacttcaagcagcatggtgcccaaggaaaatttattgctttttaccttttggggatgtttattccttatctttatgcattgtacctcatctgggcagtatttgagatgtttacccctatcctcgggagaagtggttctgaaatcccacctgatgttgtgctggcatccattttggctggctgtacaatgattctctcgtcctattttattaacttcatctaccttgccaagagcacaaaaaaaaccatgctaactttaactttggtatgtgcaattacattcctccttgtttgcagtggaacattttttccatatagctccaatcctgctaatccgaagccaaagagagtgtttcttcagcatatgactagaacattccatgacttggaaggaaatgcagttaaacgggactctggaatatggatcaatgggtttgattatactggaatttctcacataacccctcacattcctgagatcaatgatagtatccgagctcactgtgaggagaatgcacctctttgtggttttccttggtatcttccagtgcactttctgatcaggaaaaactggtatcttcctgccccagaagtttctccaagaaatcctcctcatttccgactcatatccaaagaacagacaccttgggattctataaaattgacttttgaagcaacaggaccaagccatatgtccttctatgttcgagcccacaaagggtcaacactttctcagtggtctcttggcaatggcaccccagtcacaagtaaaggaggagactactttgtcttttactcccatggactccaggcctctgcatggcagttctggatagaagtgcaggtttcagaagaacatcctgaaggaatggtcaccgtggccattgctgcccactatctgtctggggaagacaagagatcccctcaactggatgctctgaaggaaaagttcccagattggacatttccctctgcctgggtgtgcacctacgatctctttgtattttaatcttgtggatgagctctaagtacatgcccagtggatactccatgtgacatggtttctccctatgttacgtggatgtttgtaacgtaagtcaatgaattttaatgatcatatgttcaaagagctttctgggttaacgcttttcagggccaagcactataagggtttagctgtggcgcagtgatgcatggcctgttgacacttgaaaatgccagtcttttggcacttcagcacatgtgggtactgccactacacacacgtcattttatatgaccttaaggacaaagccaacaatccacttcaatagctgcccctttaggatcaagaaagatgtacactgtcagagcattgttaatgagacaaaagttgtttccaatttaagccccaaaaccatttgttgtattagtggatggtgggtaaaatatcattcactgaggtaatgattccccttgagaatataactctgtgtaggtcactggaaagtgattgccatagggctgggagagaagcattgcactcttgaggctgtagcctgtgtcaagctgtttcttcaggcagcctctcaaatgtgctttgtctctctgtgctgaggcctggaccctgtgctgagctggtgactcactgtcctgacaagtggacacacagatgcactgctgtgctgctttcctgaggtggttttctatgcctgttttcctctgaaacatgtctgttacccctctccatcttaccaagttgaaaaggggaatatttggccacatacccctctggttttcgtaggttcttttggttcagaatattgtttgtgccagtacatgaccttaacttccttcctcagagcactgagctgccatctgggctattctggggtagaaggaaggctgggagtggtgggaattttataaatatttattctcttttctttgtttcataggagtcttgtgttatacaaggttagtccttcatggtataatcttactgatgcactgggcctatctttttgttttccagccagttgaatagattagtttttctcagtaacttactatccagcagactggctttcctgagacttgaggttgtggcttatactggaatgagaccactgtacgtgtaggtggttcagatcctgcgtaatggcagcatgaggacttaaaaggtggttttcattttgaagatggctatgtagcttgtaaggtgtatcacagcagtacctctcatggctttttggttccagcagtgagggcattggtgagatcaatggtaaactgtgcaagctttctttttatcattaggaaatgtgaaacgttggacaaattttgagttttaacaaggacaaaaagttgaaagaaaaggcacagttaacaaaaaagggtggctagatttatcttgggtgatggaggaaatgagagaggaatgctcttgaaaggtggtctgtggatctgtctgaatagaaagagcacagtaagtatgcattgccggagaaaacgtccttgaagctgcttgtctcatgtgtatgatgtgctttttaaatcatgcccctcgttgcctgcctaatctgtgactccctaaaaactaactgggcccatgtagatggggctgcaaccagagctgaataacatgttaggctcacacatgcatcagcactgcacactggaatcattgctcttcctggactttgtagaaatcagtctcaagtgcttcaagagtctggctcctgctacttttatctgtcaggtagcacataaggtttgcagggtttatattttgtatagaatcacagttgtggagaaaaagtaataatttctcaatgaattttaaaaatgggcctattttctatccccgtggttcatctgatataattagtgttccctgtgaattccccccctctatgggaaggatgcctttactctttatcagtaataaattatgactgttttcatattgccttagggtt

SEQ ID NO: 304882 - DNA, 4464 bp, Homo sapiens
aacttctctccgtaaaagatgttgcccacttgccatttctaggccaggaggaagagattggaactctggagagtctttcttgttttgtctcagggtgtctttacatttggcaatctccgtcctacagagggctggaaaagccctgcgggagacggcatatccaccacccgctgctgggtcggccctgcagctgtgtgcacccgagaactgccaaagaagctgggtcttggcgcggcgggacgggccaatcagaagaagtttggccctctgcagtttccgtccgctcactaggaggcgctgcggcagcgacggcggcgtcggcggcggccggggctgtcgcgggttggggcggttgggctggcagctgaggctcgtggccatggagtggggttctgagtcggctgctgtgaggcggcaccgcgtcggagtagagcgtcgagagggagcggcggccgcgccaccgccggagagggaggcccgagcgcaggagcctctggtggatgggtgcagcggcggcgggaggacgcggaagaggagccccgggggtagcggcggcgcgagcaggggcgcggggaccgggctgtctgaggtgcgcgccgcgctggggctcgcgctctacctgatcgcgctgcggacgctggtgcagctctcgctgcagcagctcgtgctacgcggggccgctggacaccgcggggagttcgacgcgctccaagccagggattatcttgaacacataacctccattggccccaggactacaggaagtccagaaaatgaaattctgaccgtgcactaccttttggaacagattaaactgattgaagtgcaaagcaacagccttcataagatttcagtagatgtacaacggcccacaggctcttttagcattgatttcttgggaggttttacaagctattatgacaacatcaccaatgttgtggtaaagctggaacccagagatggagcccagcatgctgtcttggctaattgtcattttgactcagtagcaaactcaccaggtgccagtgatgatgcagttagctgctcagtgatgctggaagtccttcgcgtcttgtcaacatcttcagaagccttgcatcatgctgtcatatttctctttaatggtgctgaggaaaatgtcttgcaagccagtcatggtttcattactcagcacccctgggctagcttgattcgtgcattcattaacctagaggcagcaggtgtaggagggaaagaacttgtattccaaacaggtcctgaaaatccttggttggttcaagcttatgtttcagcagctaaacacccttttgcttctgtggtggctcaggaggtttttcagagtggaatcattccttcagatactgactttcgtatctacagggattttgggaacattccaggaatagacttagcttttattgagaatggatacatttatcacaccaagtatgacacagcggacagaattctaacagattccattcagagagcaggtgacaacattttagcagttcttaagcatctagctacatctgatatgctggctgctgcttctaagtatcgacatggaaacatggtcttctttgatgtgctgggcctgtttgtcattgcctacccctctcgtattggctcaatcataaactacatggtggtaatgggtgttgttttgtacctgggcaaaaaatttttgcagcccaaacataagactggtaactacaagaaggacttcttgtgtggacttggcatcactttgatcagctggttcactagccttgttaccgttctcattatagcagtgttcatctctcttattggacagtctctctcatggtataaccacttctatgtctccgtttgtctgtatggaactgcaactgtagccaaaataatacttatacatactcttgcgaaaagattttattacatgaatgccagtgcccagtatctgggagaagtattttttgacatttcgctgtttgtccattgctgttttcttgttaccctcacttaccaaggactttgctcggcgtttattagtgctgtctgggtagcattcccattgctcacaaagctctgtgtgcataaggacttcaagcagcatggtgcccaaggaaaatttattgctttttaccttttggggatgtttattccttatctttatgcattgtacctcatctgggcagtatttgagatgtttacccctatcctcgggagaagtggttctgaaatcccacctgatgttgtgctggcatccattttggctggctgtacaatgattctctcgtcctattttattaacttcatctaccttgccaagagcacaaaaaaaaccatgctaactttaactttggtatgtgcaattacattcctccttgtttgcagtggaacattttttccatatagctccaatcctgctaatccgaagccaaagagagtgtttcttcagcatatgactagaacattccatgacttggaaggaaatgcagttaaacgggactctggaatatggatcaatgggtttgattatactggaatttctcacataacccctcacattcctgagatcaatgatagtatccgagctcactgtgaggagaatgcacctctttgtggttttccttggtatcttccagtgcactttctgatcaggaaaaactggtatcttcctgccccagaagtttctccaagaaatcctcctcatttccgactcatatccaaagaacagacaccttgggattctataaaattgacttttgaagcaacaggaccaagccatatgtccttctatgttcgagcccacaaagggtcaacactttctcagtggtctcttggcaatggcaccccagtcacaagtaaaggaggagactactttgtcttttactcccatggactccaggcctctgcatggcagttctggatagaagtgcaggtttcagaagaacatcctgaaggaatggtcaccgtggccattgctgcccactatctgtctggggaagacaagagatcccctcaactggatgctctgaaggaaaagttcccagattggacatttccctctgcctgggtgtgcacctacgatctctttgtattttaatcttgtggatgagctctaagtacatgcccagtggatactccatgtgacatggtttctccctatgttacgtggatgtttgtaacgtaagtcaatgaattttaatgatcatatgttcaaagagctttctgggttaacgcttttcagggccaagcactataagggtttagctgtggcgcagtgatgcatggcctgttgacacttgaaaatgccagtcttttggcacttcagcacatgtgggtactgccactacacacacgtcattttatatgaccttaaggacaaagccaacaatccacttcaatagctgcccctttaggatcaagaaagatgtacactgtcagagcattgttaatgagacaaaagttgtttccaatttaagccccaaaaccatttgttgtattagtggatggtgggtaaaatatcattcactgaggtaatgattccccttgagaatataactctgtgtaggtcactggaaagtgattgccatagggctgggagagaagcattgcactcttgaggctgtagcctgtgtcaagctgtttcttcaggcagcctctcaaatgtgctttgtctctctgtgctgaggcctggaccctgtgctgagctggtgactcactgtcctgacaagtggacacacagatgcactgctgtgctgctttcctgaggtggttttctatgcctgttttcctctgaaacatgtctgttacccctctccatcttaccaagttgaaaaggggaatatttggccacatacccctctggttttcgtaggttcttttggttcagaatattgtttgtgccagtacatgaccttaacttccttcctcagagcactgagctgccatctgggctattctggggtagaaggaaggctgggagtggtgggaattttataaatatttattctcttttctttgtttcataggagtcttgtgttatacaaggttagtccttcatggtataatcttactgatgcactgggcctatctttttgttttccagccagttgaatagattagtttttctcagtaacttactatccagcagactggctttcctgagacttgaggttgtggcttatactggaatgagaccactgtacgtgtaggtggttcagatcctgcgtaatggcagcatgaggacttaaaaggtggttttcattttgaagatggctatgtagcttgtaaggtgtatcacagcagtacctctcatggctttttggttccagcagtgagggcattggtgagatcaatggtaaactgtgcaactgtagaaggagtgtttgtcaatttcttgtcactggtttgctgacttactgaggattaattgttgccttacaatgttactgaaataaactgtttaatata

SEQ ID NO: 304883 - DNA, 88 bp, Homo sapiens
taatgtttgcccatttagctctactgactggttatataactgatttgatgaagatggtgatttcaactttttgttttctcttcattag

SEQ ID NO: 304884 - DNA, 271 bp, Homo sapiens
taagattgtttaacaaatatttgttttctttccttctctttaaggccagtcatggtttcattactcagcacccctgggctagcttgattcgtgcattcattaacctagaggcagcaggtgtaggagggaaagaacttgtattccaaacaggtatgtgagattgtgcgttgtatattttaatgcaattctagtttttgtaaaagtagaaagtttttgattataaataatatcttcaataaacagtctcttgaatgagcattctttttaaagc

SEQ ID NO: 304885 - DNA, 708 bp, Homo sapiens
  misc_feature (504)..(504): n is a, c, g, or t
  misc_feature (548)..(548): n is a, c, g, or t
  misc_feature (627)..(627): n is a, c, g, or t
  misc_feature (703)..(703): n is a, c, g, or t
  misc_feature (708)..(708): n is a, c, g, or t
agccagcagagaaggcggaagcagtggcgtccgcagctggggcttggcctgcgggcggccagcgaaggtggcgaaggctcccactggatccagagtttgccgtccaagcagcctcgtctcggcgcgcagtgtctgtgtccgtcctctaccagcgccttggctgagcggagtcgtgcggttggtgggggaggcatgtgctccgaaaaaagactaaaagaacgatgagacagacgatgaattatcattagacgatctaattgatagagagcgaaatcgcctaggtacaaatgctaccaaaatcactctagaatctgtgcttgctcggatacaagggacacgcatggaaagcactaatgatcagtgatcgtgaagtgatcgaatctcgtactgaactggtcaatgatgatgatgaggaatcagatgataccaactacacgcagcgaacatgcggtcgatgagtctgtgaatcagcgagagtaaatgaatagagttaacgctgacatncgacgagatgcagatgaaacactgatgactgtcaccagtctcgnacaatcatcgcatatactgcagatcaagatgaaacgagataagtcaagctactgaggttgactagatgtgctaagaatnacttgacatgacacataggaggactgtaatgagcatcatgccagctgtacgaaattctactagaagatcgatactnacgtn

SEQ ID NO: 304886 - DNA, 3689 bp, Homo sapiens
agccagcagagaaggcggaagcagtggcgtccgcagctggggcttggcctgcgggcggccagcgaaggtggcgaaggctcccactggatccagagtttgccgtccaagcagcctcgtctcggcgcgcagtgtctgtgtccgtcctctaccagcgccttggctgagcggagtcgtgcggttggtgggggagccctgccctcctggttcggcctccccgcgcactagaacgagcaagtgataatcaagttactatgagtctgctaaactgtgaaaacagctgtggatccagccagtctgaaagtgactgctgtgtggccatggccagctcctgtagcgctgtaacaaaagatgatagtgtgggtggaactgccagcacggggaacctctccagctcatttatggaggagatccagggatatgatgtagagtttgacccacccctggaaagcaagtatgaatgccccatctgcttgatggcattacgagaagcagtgcaaacgccatgcggccataggttctgcaaagcctgcatcataaaatcaataagggatgcaggtcacaaatgtccagttgacaatgaaatactgctggaaaatcaactatttccagacaattttgcaaaacgtgagattctttctctgatggtgaaatgtccaaatgaaggttgtttgcacaagatggaactgagacatcttgaggatcatcaagcacattgtgagtttgctcttatggattgtccccaatgccagcgtcccttccaaaaattccatattaatattcacattctgaaggattgtccaaggagacaggtttcttgtgacaactgtgctgcatcaatggcatttgaagataaagagatccatgaccagaactgtcctttggcaaatgtcatctgtgaatactgcaatactatactcatcagagaacagatgcctaatcattatgatctagactgccctacagccccaattccatgcacattcagtacttttggttgccatgaaaagatgcagaggaatcacttggcacgccacctacaagagaacacccagtcacacatgagaatgttggcccaggctgttcatagtttgagcgttatacccgactctgggtatatctcagaggtccggaatttccaggaaactattcaccagttagagggtcgccttgtaagacaagaccatcaaatccgggagctgactgctaaaatggaaactcagagtatgtatgtaagtgagctcaaacgaaccattcgaacccttgaggacaaagttgctgaaatcgaagcacagcagtgcaatggaatttatatttggaagattggcaactttggaatgcatttgaaatgtcaagaagaggagaaacctgttgtgattcatagccctggattctacactggcaaacccgggtacaaactgtgcatgcgcttgcaccttcagttaccgactgctcagcgctgtgcaaactatatatccctttttgtccacacaatgcaaggagaatatgacagccacctcccttggcccttccagggtacaatacgccttacaattcttgatcagtctgaagcacctgtaaggcaaaaccacgaagagataatggatgccaaaccagagctgcttgctttccagcgacccacaatcccacggaacccaaaaggttttggctatgtaacttttatgcatctggaagccctaagacaaagaactttcattaaggatgacacattattagtgcgctgtgaggtctccacccgctttgacatgggtagccttcggagggagggttttcagccacgaagtactgatgcaggggtatagcttgccctcacttgctcaaaaacaactacctggagaaaacagtgcctttccttgccctgttctcaataacatgcaaacaaacaagccacgggaaatatgtaatatctactagtgagtgttgttagagaggtcacttactatttcttcctgttacaaatgatctgaggcagttttttcctgggaatccacacgttccatgctttttcagaaatgttaggcctgaagtgcctgtggcatgttgcagcagctattttgccagttagtatacctctttgttgtactttcttgggcttttgctctggtgtattttattgtcagaaagtccagactcaagagtactaaacttttaataataatggattttccttaaaacttcagtctttttgtagtattatatgtaatatattaaaagtgaaaatcactaccgccttgtgctagtgccctcgagaagagttattgctctagaaagttgagttctcatttttttaacctgttatagatttcagaggatttgaaccataatccttggaaaacttaagttctcattcaccccagtttttcctccaggttgttactaaggatattcagggatgagtttaaaccctaaatataaccttaattatttagtgtaaacatgtctgttgaataatacttgtttaagtgttccttctgccttgcttacttatttccttgaggttacgaagtagcatcttccccagagtttataatgctgagaaccacgtggataccaactgctcattgttatgctatgtaaccctttttgtctattcagtgcagagtgaatttcacagctctgcatatgtcttcatttgtttaatgcttacaagacaggagatgcacacatacaatcagcaacataaaaattaaaagtgacccaagtagtcagcgcatgtggcatctcattggtggtgacagaagctatgtgagccagaagttttcagctcttttgaataccctctggtttatttcgattaaaaagaacaaaattgatttcctaaaatcagaattttttaaaacttgggagatgattggagatacctaggaggtcaccaaactaggattagaagtcacagtggttgtatcacaacttagcttgagtatgttgctgtagcctaacaactgcaggttctgagaaggatcctgtagaatcctggaagtaaccagattttcctaatagggagatgatttttttgtgtgccatcatgtatttgttaaaggcctatatatagatataaaatatcgtggaatctagttctcagggagacccgcaactagtataagcttataaaggatctaaagatccatccaccatttaaagttgtctggtaatgagagatgacattgtatcccccagagaggccaaatcagagtcgccagccagcgttctagatcagccttaatttcaagagaaagccaaggacctcatctgcaggggagtgtggttttcagccccagcgagtgtcactttgaactttccctttgcttttttctctcttctccctccccacccacccttaggctcctgatctggtgagtttgttatggagtgaaaataaaagtcaagcagagaccttgtttcccgtgccaccattagtaccacaagctcatggctagttaccacattacttcctggcagtttgtgtccctcagctgtgccttccaaccagcgcctgagaatcactgcataccaccctctaggtagggaaacctacactgctgctgttcctgtgattattttacaatgaataaataattgtcaagttccatttaaaaactgaacagtagtatttttgtatttgcgtagaaaaagcctgaaggaaatatactaaactttttgttggcttattt

SEQ ID NO: 304887 - DNA, 3549 bp, Homo sapiens
agccagcagagaaggcggaagcagtggcgtccgcagctggggcttggcctgcgggcggccagcgaaggtggcgaaggctcccactggatccagagtttgccgtccaagcagcctcgtctcggcgcgcagtgtctgtgtccgtcctctaccagcgccttggctgagcggagtcgtgcggttggtgggggagccctgccctcctggttcggcctccccgcgcactagaacgagcaagtgataatcaagttactatgagtctgctaaactgtgaaaacagctgtggatccagccagtctgaaagtgactgctgtgtggccatggccagctcctgtagcgctgtaacaaaagatgatagtgtgggtggaactgccagcacggggaacctctccagctcatttatggaggagatccagggatatgatgtagagtttgacccacccctggaaagcaagtatgaatgccccatctgcttgatggcattacgagaagcagtgcaaacgccatgcggccataggttctgcaaagcctgcatcataaaatcaataagggatgcaggtcacaaatgtccagttgacaatgaaatactgctggaaaatcaactatttccagacaattttgcaaaacgtgagattctttctctgatggtgaaatgtccaaatgaaggttgtttgcacaagatggaactgagacatcttgaggatcatcaagcacattgtgagtttgctcttatggattgtccccaatgccagcgtcccttccaaaaattccatattaatattcacattctgaaggattgtccaaggagacaggtttcttgtgacaactgtgctgcatcaatggcatttgaagataaagagatccatgaccagaactgtcctttggcaaatgtcatctgtgaatactgcaatactatactcatcagagaacagatgcctaatcattatgatctagactgccctacagccccaattccatgcacattcagtacttttggttgccatgaaaagatgcagaggaatcacttggcacgccacctacaagagaacacccagtcacacatgagaatgttggcccaggctgttcatagtttgagcgttatacccgactctgggtatatctcagaggtccggaatttccaggaaactattcaccagttagagggtcgccttgtaagacaagaccatcaaatccgggagctgactgctaaaatggaaactcagagtatgtatgtaagtgagctcaaacgaaccattcgaacccttgaggacaaagttgctgaaatcgaagcacagcagtgcaatggaatttatatttggaagattggcaactttggaatgcatttgaaatgtcaagaagaggagaaacctgttgtgattcatagccctggattctacactggcaaacccgggtacaaactgtgcatgcgcttgcaccttcagttaccgactgctcagcgctgtgcaaactatatatccctttttgtccacacaatgcaaggagaatatgacagccacctcccttggcccttccagggtacaatacgccttacaattcttgatcagtctgaagcacctgtaaggcaaaaccacgaagagataatggatgccaaaccagagctgcttgctttccagcgacccacaatcccacggaacccaaaaggttttggctatgtaacttttatgcatctggaagccctaagacaaagaactttcattaaggatgacacattattagtgcgctgtgaggtctccacccgctttgacatgggtagccttcggagggagggttttcagccacgaagtactgatgcaggggtatagcttgccctcacttgctcaaaaacaactacctggagaaaacagtgcctttccttgccctgttctcaataacatgcaaacaaacaagccacgggaaatatgtaatatctactagtgagtgttgttagagaggtcacttactatttcttcctgttacaaatgatctgaggcagttttttcctgggaatccacacgttccatgctttttcagaaatgttaggcctgaagtgcctgtggcatgttgcagcagctattttgccagttagtatacctctttgttgtactttcttgggcttttgctctggtgtattttattgtcagaaagtccagactcaagagtactaaacttttaataataatggattttccttaaaacttcagtctttttgtagtattatatgtaatatattaaaagtgaaaatcactaccgccttgtgctagtgccctcgagaagagttattgctctagaaagttgagttctcatttttttaacctgttatagatttcagaggatttgaaccataatccttggaaaacttaagttctcattcaccccagtttttcctccaggttgttactaaggatattcagggatgagtttaaaccctaaatataaccttaattatttagtgtaaacatgtctgttgaataatacttgtttaagtgttccttctgccttgcttacttatttccttgaggttacgaagtagcatcttccccagagtttataatgctgagaaccacgtggataccaactgctcattgttatgctatgtaaccctttttgtctattcagtgcagagtgaatttcacagctctgcatatgtcttcatttgtttaatgcttacaagacaggagatgcacacatacaatcagcaacataaaaattaaaagtgacccaagtagtcagcgcatgtggcatctcattggtggtgacagaagctatgtgagccagaagttttcagctcttttgaataccctctggtttatttcgattaaaaagaacaaaattgatttcctaaaatcagaattttttaaaacttgggagatgattggagatacctaggaggtcaccaaactaggattagaagtcacagtggttgtatcacaacttagcttgagtatgttgctgtagcctaacaactgcaggttctgagaaggatcctgtagaatcctggaagtaaccagattttcctaatagggagatgatttttttgtgtgccatcatgtatttgttaaaggcctatatatagatataaaatatcgtggaatctagttctcagggagacccgcaactagtataagcttataaaggatctaaagatccatccaccatttaaagttgtctggtaatgagagatgacattgtatcccccagagaggccaaatcagagtcgccagccagcgttctagatcagccttaatttcaagagaaaataaaagtcaagcagagaccttgtttcccgtgccaccattagtaccacaagctcatggctagttaccacattacttcctggcagtttgtgtccctcagctgtgccttccaaccagcgcctgagaatcactgcataccaccctctaggtagggaaacctacactgctgctgttcctgtgattattttacaatgaataaataattgtcaagttccatttaaaaactgaacagtagtatttttgtatttgcgtagaaaaagcctgaaggaaatatactaaactttttgttggcttattt

SEQ ID NO: 304888 - DNA, 3782 bp, Homo sapiens
agccagcagagaaggcggaagcagtggcgtccgcagctggggcttggcctgcgggcggccagcgaaggtggcgaaggctcccactggatccagagtttgccgtccaagcagcctcgtctcggcgcgcagtgtctgtgtccgtcctctaccagcgccttggctgagcggagtcgtgcggttggtgggggagccctgccctcctggttcggcctccccgcgcactagaacgatcatgaacttctgaagggacccagctttctttgtgtgctccaagtgatttgcacaaataataatatatatatttattgaaggagagaatcagagcaagtgataatcaagttactatgagtctgctaaactgtgaaaacagctgtggatccagccagtctgaaagtgactgctgtgtggccatggccagctcctgtagcgctgtaacaaaagatgatagtgtgggtggaactgccagcacggggaacctctccagctcatttatggaggagatccagggatatgatgtagagtttgacccacccctggaaagcaagtatgaatgccccatctgcttgatggcattacgagaagcagtgcaaacgccatgcggccataggttctgcaaagcctgcatcataaaatcaataagggatgcaggtcacaaatgtccagttgacaatgaaatactgctggaaaatcaactatttccagacaattttgcaaaacgtgagattctttctctgatggtgaaatgtccaaatgaaggttgtttgcacaagatggaactgagacatcttgaggatcatcaagcacattgtgagtttgctcttatggattgtccccaatgccagcgtcccttccaaaaattccatattaatattcacattctgaaggattgtccaaggagacaggtttcttgtgacaactgtgctgcatcaatggcatttgaagataaagagatccatgaccagaactgtcctttggcaaatgtcatctgtgaatactgcaatactatactcatcagagaacagatgcctaatcattatgatctagactgccctacagccccaattccatgcacattcagtacttttggttgccatgaaaagatgcagaggaatcacttggcacgccacctacaagagaacacccagtcacacatgagaatgttggcccaggctgttcatagtttgagcgttatacccgactctgggtatatctcagaggtccggaatttccaggaaactattcaccagttagagggtcgccttgtaagacaagaccatcaaatccgggagctgactgctaaaatggaaactcagagtatgtatgtaagtgagctcaaacgaaccattcgaacccttgaggacaaagttgctgaaatcgaagcacagcagtgcaatggaatttatatttggaagattggcaactttggaatgcatttgaaatgtcaagaagaggagaaacctgttgtgattcatagccctggattctacactggcaaacccgggtacaaactgtgcatgcgcttgcaccttcagttaccgactgctcagcgctgtgcaaactatatatccctttttgtccacacaatgcaaggagaatatgacagccacctcccttggcccttccagggtacaatacgccttacaattcttgatcagtctgaagcacctgtaaggcaaaaccacgaagagataatggatgccaaaccagagctgcttgctttccagcgacccacaatcccacggaacccaaaaggttttggctatgtaacttttatgcatctggaagccctaagacaaagaactttcattaaggatgacacattattagtgcgctgtgaggtctccacccgctttgacatgggtagccttcggagggagggttttcagccacgaagtactgatgcaggggtatagcttgccctcacttgctcaaaaacaactacctggagaaaacagtgcctttccttgccctgttctcaataacatgcaaacaaacaagccacgggaaatatgtaatatctactagtgagtgttgttagagaggtcacttactatttcttcctgttacaaatgatctgaggcagttttttcctgggaatccacacgttccatgctttttcagaaatgttaggcctgaagtgcctgtggcatgttgcagcagctattttgccagttagtatacctctttgttgtactttcttgggcttttgctctggtgtattttattgtcagaaagtccagactcaagagtactaaacttttaataataatggattttccttaaaacttcagtctttttgtagtattatatgtaatatattaaaagtgaaaatcactaccgccttgtgctagtgccctcgagaagagttattgctctagaaagttgagttctcatttttttaacctgttatagatttcagaggatttgaaccataatccttggaaaacttaagttctcattcaccccagtttttcctccaggttgttactaaggatattcagggatgagtttaaaccctaaatataaccttaattatttagtgtaaacatgtctgttgaataatacttgtttaagtgttccttctgccttgcttacttatttccttgaggttacgaagtagcatcttccccagagtttataatgctgagaaccacgtggataccaactgctcattgttatgctatgtaaccctttttgtctattcagtgcagagtgaatttcacagctctgcatatgtcttcatttgtttaatgcttacaagacaggagatgcacacatacaatcagcaacataaaaattaaaagtgacccaagtagtcagcgcatgtggcatctcattggtggtgacagaagctatgtgagccagaagttttcagctcttttgaataccctctggtttatttcgattaaaaagaacaaaattgatttcctaaaatcagaattttttaaaacttgggagatgattggagatacctaggaggtcaccaaactaggattagaagtcacagtggttgtatcacaacttagcttgagtatgttgctgtagcctaacaactgcaggttctgagaaggatcctgtagaatcctggaagtaaccagattttcctaatagggagatgatttttttgtgtgccatcatgtatttgttaaaggcctatatatagatataaaatatcgtggaatctagttctcagggagacccgcaactagtataagcttataaaggatctaaagatccatccaccatttaaagttgtctggtaatgagagatgacattgtatcccccagagaggccaaatcagagtcgccagccagcgttctagatcagccttaatttcaagagaaagccaaggacctcatctgcaggggagtgtggttttcagccccagcgagtgtcactttgaactttccctttgcttttttctctcttctccctccccacccacccttaggctcctgatctggtgagtttgttatggagtgaaaataaaagtcaagcagagaccttgtttcccgtgccaccattagtaccacaagctcatggctagttaccacattacttcctggcagtttgtgtccctcagctgtgccttccaaccagcgcctgagaatcactgcataccaccctctaggtagggaaacctacactgctgctgttcctgtgattattttacaatgaataaataattgtcaagttccatttaaaaactgaacagtagtatttttgtatttgcgtagaaaaagcctgaaggaaatatactaaactttttgttggcttattt

SEQ ID NO: 304889 - DNA, 3371 bp, Homo sapiens
agccagcagagaaggcggaagcagtggcgtccgcagctggggcttggcctgcgggcggccagcgaaggtggcgaaggctcccactggatccagagtttgccgtccaagcagcctcgtctcggcgcgcagtgtctgtgtccgtcctctaccagcgccttggctgagcggagtcgtgcggttggtgggggagccctgccctcctggttcggcctccccgcgcactagaacgggatgcaggtcacaaatgtccagttgacaatgaaatactgctggaaaatcaactatttccagacaattttgcaaaacgtgagattctttctctgatggtgaaatgtccaaatgaaggttgtttgcacaagatggaactgagacatcttgaggatcatcaagcacattgtgagtttgctcttatggattgtccccaatgccagcgtcccttccaaaaattccatattaatattcacattctgaaggattgtccaaggagacaggtttcttgtgacaactgtgctgcatcaatggcatttgaagataaagagatccatgaccagaactgtcctttggcaaatgtcatctgtgaatactgcaatactatactcatcagagaacagatgcctaatcattatgatctagactgccctacagccccaattccatgcacattcagtacttttggttgccatgaaaagatgcagaggaatcacttggcacgccacctacaagagaacacccagtcacacatgagaatgttggcccaggctgttcatagtttgagcgttatacccgactctgggtatatctcagaggtccggaatttccaggaaactattcaccagttagagggtcgccttgtaagacaagaccatcaaatccgggagctgactgctaaaatggaaactcagagtatgtatgtaagtgagctcaaacgaaccattcgaacccttgaggacaaagttgctgaaatcgaagcacagcagtgcaatggaatttatatttggaagattggcaactttggaatgcatttgaaatgtcaagaagaggagaaacctgttgtgattcatagccctggattctacactggcaaacccgggtacaaactgtgcatgcgcttgcaccttcagttaccgactgctcagcgctgtgcaaactatatatccctttttgtccacacaatgcaaggagaatatgacagccacctcccttggcccttccagggtacaatacgccttacaattcttgatcagtctgaagcacctgtaaggcaaaaccacgaagagataatggatgccaaaccagagctgcttgctttccagcgacccacaatcccacggaacccaaaaggttttggctatgtaacttttatgcatctggaagccctaagacaaagaactttcattaaggatgacacattattagtgcgctgtgaggtctccacccgctttgacatgggtagccttcggagggagggttttcagccacgaagtactgatgcaggggtatagcttgccctcacttgctcaaaaacaactacctggagaaaacagtgcctttccttgccctgttctcaataacatgcaaacaaacaagccacgggaaatatgtaatatctactagtgagtgttgttagagaggtcacttactatttcttcctgttacaaatgatctgaggcagttttttcctgggaatccacacgttccatgctttttcagaaatgttaggcctgaagtgcctgtggcatgttgcagcagctattttgccagttagtatacctctttgttgtactttcttgggcttttgctctggtgtattttattgtcagaaagtccagactcaagagtactaaacttttaataataatggattttccttaaaacttcagtctttttgtagtattatatgtaatatattaaaagtgaaaatcactaccgccttgtgctagtgccctcgagaagagttattgctctagaaagttgagttctcatttttttaacctgttatagatttcagaggatttgaaccataatccttggaaaacttaagttctcattcaccccagtttttcctccaggttgttactaaggatattcagggatgagtttaaaccctaaatataaccttaattatttagtgtaaacatgtctgttgaataatacttgtttaagtgttccttctgccttgcttacttatttccttgaggttacgaagtagcatcttccccagagtttataatgctgagaaccacgtggataccaactgctcattgttatgctatgtaaccctttttgtctattcagtgcagagtgaatttcacagctctgcatatgtcttcatttgtttaatgcttacaagacaggagatgcacacatacaatcagcaacataaaaattaaaagtgacccaagtagtcagcgcatgtggcatctcattggtggtgacagaagctatgtgagccagaagttttcagctcttttgaataccctctggtttatttcgattaaaaagaacaaaattgatttcctaaaatcagaattttttaaaacttgggagatgattggagatacctaggaggtcaccaaactaggattagaagtcacagtggttgtatcacaacttagcttgagtatgttgctgtagcctaacaactgcaggttctgagaaggatcctgtagaatcctggaagtaaccagattttcctaatagggagatgatttttttgtgtgccatcatgtatttgttaaaggcctatatatagatataaaatatcgtggaatctagttctcagggagacccgcaactagtataagcttataaaggatctaaagatccatccaccatttaaagttgtctggtaatgagagatgacattgtatcccccagagaggccaaatcagagtcgccagccagcgttctagatcagccttaatttcaagagaaagccaaggacctcatctgcaggggagtgtggttttcagccccagcgagtgtcactttgaactttccctttgcttttttctctcttctccctccccacccacccttaggctcctgatctggtgagtttgttatggagtgaaaataaaagtcaagcagagaccttgtttcccgtgccaccattagtaccacaagctcatggctagttaccacattacttcctggcagtttgtgtccctcagctgtgccttccaaccagcgcctgagaatcactgcataccaccctctaggtagggaaacctacactgctgctgttcctgtgattattttacaatgaataaataattgtcaagttccatttaaaaactgaacagtagtatttttgtatttgcgtagaaaaagcctgaaggaaatatactaaactttttgttggcttattt

SEQ ID NO: 304890 - DNA, 3095 bp, Homo sapiens
aggaaagtgttagaggaagagatgtttaaagatgaagaaaaatcactgagtaaaatctctggggtgtcgcaacaggtcaggtaacatttagagcacaggtagaatgttaatcttggagaggacaggcatctcagttagaaaagaaggatgtgtgtaaatacattttttgtaggtgggagggagatttatgtgagtgaaagctgggagagtagtcatcagatagtctgtttttcagtgaactaagaggcagagtcgcctcattggatcaagaatctgttgaaggcaaaggaaaattgtagagaattgagggaagtggtgtgactacttgaaaacttcttatttgacctggccaggtccttttcctactcctcacggtatctattcccagcctaaggcttgtgcttgatttttagatgcagaggaatcacttggcacgccacctacaagagaacacccagtcacacatgagaatgttggcccaggctgttcatagtttgagcgttatacccgactctgggtatatctcagaggtccggaatttccaggaaactattcaccagttagagggtcgccttgtaagacaagaccatcaaatccgggagctgactgctaaaatggaaactcagagtatgtatgtaagtgagctcaaacgaaccattcgaacccttgaggacaaagttgctgaaatcgaagcacagcagtgcaatggaatttatatttggaagattggcaactttggaatgcatttgaaatgtcaagaagaggagaaacctgttgtgattcatagccctggattctacactggcaaacccgggtacaaactgtgcatgcgcttgcaccttcagttaccgactgctcagcgctgtgcaaactatatatccctttttgtccacacaatgcaaggagaatatgacagccacctcccttggcccttccagggtacaatacgccttacaattcttgatcagtctgaagcacctgtaaggcaaaaccacgaagagataatggatgccaaaccagagctgcttgctttccagcgacccacaatcccacggaacccaaaaggttttggctatgtaacttttatgcatctggaagccctaagacaaagaactttcattaaggatgacacattattagtgcgctgtgaggtctccacccgctttgacatgggtagccttcggagggagggttttcagccacgaagtactgatgcaggggtatagcttgccctcacttgctcaaaaacaactacctggagaaaacagtgcctttccttgccctgttctcaataacatgcaaacaaacaagccacgggaaatatgtaatatctactagtgagtgttgttagagaggtcacttactatttcttcctgttacaaatgatctgaggcagttttttcctgggaatccacacgttccatgctttttcagaaatgttaggcctgaagtgcctgtggcatgttgcagcagctattttgccagttagtatacctctttgttgtactttcttgggcttttgctctggtgtattttattgtcagaaagtccagactcaagagtactaaacttttaataataatggattttccttaaaacttcagtctttttgtagtattatatgtaatatattaaaagtgaaaatcactaccgccttgtgctagtgccctcgagaagagttattgctctagaaagttgagttctcatttttttaacctgttatagatttcagaggatttgaaccataatccttggaaaacttaagttctcattcaccccagtttttcctccaggttgttactaaggatattcagggatgagtttaaaccctaaatataaccttaattatttagtgtaaacatgtctgttgaataatacttgtttaagtgttccttctgccttgcttacttatttccttgaggttacgaagtagcatcttccccagagtttataatgctgagaaccacgtggataccaactgctcattgttatgctatgtaaccctttttgtctattcagtgcagagtgaatttcacagctctgcatatgtcttcatttgtttaatgcttacaagacaggagatgcacacatacaatcagcaacataaaaattaaaagtgacccaagtagtcagcgcatgtggcatctcattggtggtgacagaagctatgtgagccagaagttttcagctcttttgaataccctctggtttatttcgattaaaaagaacaaaattgatttcctaaaatcagaattttttaaaacttgggagatgattggagatacctaggaggtcaccaaactaggattagaagtcacagtggttgtatcacaacttagcttgagtatgttgctgtagcctaacaactgcaggttctgagaaggatcctgtagaatcctggaagtaaccagattttcctaatagggagatgatttttttgtgtgccatcatgtatttgttaaaggcctatatatagatataaaatatcgtggaatctagttctcagggagacccgcaactagtataagcttataaaggatctaaagatccatccaccatttaaagttgtctggtaatgagagatgacattgtatcccccagagaggccaaatcagagtcgccagccagcgttctagatcagccttaatttcaagagaaagccaaggacctcatctgcaggggagtgtggttttcagccccagcgagtgtcactttgaactttccctttgcttttttctctcttctccctccccacccacccttaggctcctgatctggtgagtttgttatggagtgaaaataaaagtcaagcagagaccttgtttcccgtgccaccattagtaccacaagctcatggctagttaccacattacttcctggcagtttgtgtccctcagctgtgccttccaaccagcgcctgagaatcactgcataccaccctctaggtagggaaacctacactgctgctgttcctgtgattattttacaatgaataaataattgtcaagttccatttaaaaactgaacagtagtatttttgtatttgcgtagaaaaagcctgaaggaaatatactaaactttttgttggcttattt

SEQ ID NO: 304891 - DNA, 1515 bp, Homo sapiens
agccagcagagaaggcggaagcagtggcgtccgcagctggggcttggcctgcgggcggccagcgaaggtggcgaaggctcccactggatccagagtttgccgtccaagcagcctcgtctcggcgcgcagtgtctgtgtccgtcctctaccagcgccttggctgagcggagtcgtgcggttggtgggggagccctgccctcctggttcggcctccccgcgcactagaacgagcaagtgataatcaagttactatgagtctgctaaactgtgaaaacagctgtggatccagccagtctgaaagtgactgctgtgtggccatggccagctcctgtagcgctgtaacaaaagatgatagtgtgggtggaactgccagcacggggaacctctccagctcatttatggaggagatccagggatatgatgtagagtttgacccacccctggaaagcaagtatgaatgccccatctgcttgatggcattacgagaagcagtgcaaacgccatgcggccataggttctgcaaagcctgcatcataaaatcaataagggatgcaggtcacaaatgtccagttgacaatgaaatactgctggaaaatcaactatttccagacaattttgcaaaacgtgagattctttctctgatggtgaaatgtccaaatgaaggttgtttgcacaagatggaactgagacatcttgaggatcatcaagcacattgtgagtttgctcttatggattgtccccaatgccagcgtcccttccaaaaattccatattaatattcacattctgaaggattgtccaaggagacaggtttcttgtgacaactgtgctgcatcaatggcatttgaagataaagagatccatgaccagaactgtcctttggcaaatgtcatctgtgaatactgcaatactatactcatcagagaacagatgcctaatcattatgatctagactgccctacagccccaattccatgcacattcagtacttttggttgccatgaaaagatgcagaggaaatcaactttggaaggcaactacaaggaaaacaaccaagtaacacaatgtagcatcgtttggccccaggatgatacaaatatatagaaccgttaatccccgagacactggaggatatacctcaaaaggcacgcgaaatgtcacaaggaaactatatgcacacaagtatagagggggctacaatgtatagaaaagaagaaaataaatacgagagcaaagaagacaaaagcgggaacaatccaggagtaatattgttagatgagagaatctaacaaagaggaatctagtagacaccatgggaaacaacgtgtagtgataatcgaaaaacgcagagagaaagagggaaaaataatgtgaagaagaagacacagtcaaagataatcacaagttaagaacagacaccacgtcgatctaacaccagagtaattatcaaaatcaccaaaaagagtgcagaataataaagcatgaaggtggagaaaaatcatggacgaaggaggaa

SEQ ID NO: 304892 - DNA, 233 bp, Homo sapiens
aatgtgatcgcatcaaactagaaaatgatatgcaaggaagagatttttcagcctttgttttggatttcagatgcctaatcattatgatctagactgccctacagccccaattccatgcacattcagtacttttggttgccatgaaaaggtaaggtttttttttcttttaattcttgaatataagtaaaaaaaaatatttacatcatgtagtggagaataacaacaagaatgta

SEQ ID NO: 304893 - DNA, 963 bp, Homo sapiens
tttttttttttaagagcgatatatttaatacattcacaagattcgaaatgaaaaacaaacattattcatgctacaggtttttaattttccttggacaacaccaaaaacacagtactcaaacggcatgttttttttttgtttttttggtttctttttgagatggaatttcactcttgttgcccaggctggtcttgaactctgggctcaagcgatcctcctgcctcagcctccctaagtgctgggattacaagcatgagccaccacactcagccttcaaaggtatttatcatctatgtccattatactatataatagttatttgtgtcttcctccattacattataattttgacttcctgtaattcacctttgattcttcagcacttaatagtctgcctggcactaagtgctcaataaattctgaactcaaatcactaacagcaaaagaaaaattaatgaccagctatttaagacagatatataggatgaaatttctcattacattatttatgcattccccttaattgtgtgcctaacacgtttaactgccttattttatttttttacaaacagggtctcactttgtcacccaccctgaggtgcagtggtgtaactatggctcactgcagcctcaacctcccaggctcggatgatcctcctgcctcagcctcccaagtagctaggacaacaggtgcacgccaccatgcccagctaatttttgtattttttgtagagatggggtttcactatatttcccaggctggtcttgaactctgggctcaagcgatcctcctgcctcagcctccctaagtgctgggattacaggtgtgggccaccgcacctgacctgccttattttttttaaatcaaatagtagaacaacattaaaagaaatataattatctaatctctaatagcatatatgttcatatttgcatactctttcagtcaataacgttttatat

SEQ ID NO: 304894 - DNA, 909 bp, Homo sapiens
tttttttttttaagagcgatatatttaatacattcacaagattcgaaatgaaaaacaaacattattcatgctacaggtttttaattttccttggacaacaccaaaaacacagtactcaaacggcatgttttttttttgtttttttggtttctttttgagatggaatttcactcttgttgcccaggctggtcttgaactctgggctcaagcgatcctcctgcctcagcctccctaagtgctgggattacaagcatgagccaccacactcagccttcaaaggtatttatcatctatgtccattatactatataatagttatttgtgtcttcctccattacattataattttgacttcctgtaattcacctttgattcttcagcacttaatagtctgcctggcactaagtgctcaataaattctgaactcaaatcactaacagcaaaagaattatttatgcattccccttaattgtgtgcctaacacgtttaactgccttattttatttttttacaaacagggtctcactttgtcacccaccctgaggtgcagtggtgtaactatggctcactgcagcctcaacctcccaggctcggatgatcctcctgcctcagcctcccaagtagctaggacaacaggtgcacgccaccatgcccagctaatttttgtattttttgtagagatggggtttcactatatttcccaggctggtcttgaactctgggctcaagcgatcctcctgcctcagcctccctaagtgctgggattacaggtgtgggccaccgcacctgacctgccttattttttttaaatcaaatagtagaacaacattaaaagaaatataattatctaatctctaatagcatatatgttcatatttgcatactctttcagtcaataacgttttatat

SEQ ID NO: 304895 - DNA, 4848 bp, Homo sapiens
  misc_feature (1)..(1): n is a, c, g, or t
nggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatcttcagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggataccacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatagctcttcagaggagctggacccagcatggatggtggaaccacagtacctcttacactccctgtggctccaacttcaggaaataaatttcccattgcgagggacccagctctgtttctgctgcttccatcaaagccaaaaggacctacactaaagaaatgcagggtgggggtggggaaccctgagcacttttttacaattggctctgagaaaaagggagacattttaaattctttaacttcttatttctcgtcctgtctctttgcaaagtatgggcttttgtttttgttttttaagggaaacgaaatggaattcgaagggaccttttcactaaccccacttctgtgtgttctgcatggtgcctgccccagggcatctgccaactccagtatcagctctcacagtgtacttggtaccatccctgggctctgctggcgagacgaaacagctgtagagatgaaaacaggctgcagaggctggcacagcctggccggcttttctccatctggggacagtcctactccaagaacactgcacaccagctcctcacacagatcccacttacggcgcgcaacgggttctaggctgcaggcagctcgaggacccgcggccccgccccggctcggcctggcagatagcagaggcagcaggcgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaagggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcgactgtttttccaatgacattcacaagctagataccagcaccatgacatggactcttatctgtacaaagggcagccctgcacgctggagggacttccactcagccacaatgctgggaagtcacatgtatgtctttgggggccgtgcgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaagggccatgtccccgccggcgccagtgctgctgtattgttggtgacaagattgtcctctttggggtaccagtccatctcctgaggaaggcctgggagatgaatttgaccttatagatcattctgacttacacattttggacttagtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctccttgacccctggacttggtatacctccatgtggagttgttgggcgagaggtgttctctgtgctgtgaactcagtggggagctgtagcgggtgggggcatggttcctccccccttggccgagggttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttatctcgtgcc

SEQ ID NO: 304896 - DNA, 1791 bp, Homo sapiens
  misc_feature (435)..(435): n is a, c, g, or t
  misc_feature (897)..(897): n is a, c, g, or t
gtgtcacaagcaaaccctaacctcactgccaaacaaagatgctggcattatgctaagaaataaggggaatggccaggcgcggtggctcatgcctgtaatcctagcactttgagaggccaagataggcagatcacgaggtcaggagttcgaaaccagcctggccaacagggcgaaactccatctctactaaaaatagaaaaattagccaggtaaggtggcgggtgcctgtaaggtggcgggtcccagctagttgggaggctgaggcaggagaatcatttgaacctgagaggaagaggttgcaatgagccaagatcatgccattgcactccagcctgggcgacaagagcaagactctgtctcaaaaaaaaagaagggggataaagaaaaacactggaaaaaggatgacctgtagttaagtgttggcataatacaatnaaagacttaacgtttctagacactctagttgaatttggtcctttgagactgtcgtgggctcatttcctcagcgtgttgatttagtgactcctgaaggagcagacccttggtttggacctcacttttccataagacgttcaaatagatttaatgcctgagggtcgctgtcatctaaatccattcagtagactgtacagaagctggcttgggagttctcccctcagcaggcagctcccagttacccctaaagtgtaatgtcattaaaagatttgttaagcacctgctctttagcaggctgtatgctggtcttcatatcccaaaggataaaacctaatccactgtctttaggtcacagcctttgagtcatttttccagtagatgatacgacatactaagccagaaactaggtttatcagcaatatgcatttgagagccggtcaactgagctagaagtctaggaanaggatgttttcccttcttccttaagccaatgaacacatggtgaaattgaacctgtgctcttggctaattagtatcttgtcctaaacaaagagctccctggtcctgagtggagaatatctggttgcttacctctgacagctcctactgactgagggcgtaggtgtgcaagacacacacagcagcctcttagtttggaaggaacttgagagattttctatccagcttcccacttcaaaacaaatagggtttttcctaatcctcagatggatgttgagatggaaggaatactcttttggcatgaggaaatgcgattgctagtaggctctagactagtgtaactttttgtttgcaattccaaaatgaaggaataggttgagtcagacattcccactttccctctccttgttcttcctatagcctggcagctgcctcccgtgggtgggttctgtgctgtgtactttcctgaacagtgtgtctctcctttaggtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctggtatcagcattcctcagatttctctgtctccctttccctgttggaggaggtgaaagacagttttcttatagggctaacaaatattgaaatccagccgggtgcggtggctcacacctgtaatcccagcactttgggatgccaaggcaggcagatcacttgaggccgggagttcgagaccagcctggtcaacatggtgaaaccctatctctacaaaaaac

SEQ ID NO: 304897 - DNA, 1094 bp, Homo sapiens
tttccttatagtaatttccgactctccttggcctctttccagcccatgcctgttcccttcatcctggctattctgagagacttccttagagagaaggcgtgttacatcttgacttcccttgtgatctcccaaacatgggtttcatctctattttctagacccttaagtatataattctttaaattatgcaagcactgtatgaaagggaccaaacttttatgcagtagtcatcattttaagaattacctgagtgtatgcaaatggctataaagccaacctaatgttctcatcaaatccttagctctactgaaggaggtggactatcagagaccaagactatactatcttacagggccgcatcagaatgaagaattcaaagagaaagccaagatagccttacttagaatagaatggattgttcctttacctagaactttgctaggggctagaaattgctttggtaattggtactatgacctttcattcatagcaatcgtacccagtagagaaatggataatagtagttatttaaaacattcttgttcatgtccctgcccatggcatcttggcagaaaattagaaagataaatattgacatctgttctaggataccacaagaaggatccacgtttcaacagatcaaggggacacatggagcatggcccagctcccctccgtgggacaggaacagttctattcccatgtgcctgttgttcagccctctctcttgttccctttctgagcatgtggtccttccccaggctgtgggacagctgccttcccacgaaagtgtaaagcagtattaagatcattactgcatgtgccctaaaaacccaagttttctattcccttaggacagaaaattgcatgtgaggtgggataatcgagtttcagtgacccacgtcagttacacattaaagccagaccccatgataaaattccacaaaatggaaataaaactcaaatttctttagcattgtgtaaataaatctgaatgtgtttaactttgtactggtaattttctgtatatttggaatatttgggttaaaaataaaacagactggactttgttacctgaaaaaaaaaaaaactaa

SEQ ID NO: 304898 - DNA, 7038 bp, Homo sapiens
  misc_feature (1)..(1): n is a, c, g, or t
nggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatcttcagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggataccacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatagctcttcagaggagctggacccagcatggatggtggaaccacagtacctcttacactccctgtggctccaacttcaggaaataaatttcccattgcgagggacccagctctgtttctgctgcttccatcaaagccaaaaggacctacactaaagaaatgcagggtgggggtggggaaccctgagcacttttttacaattggctctgagaaaaagggagacattttaaattctttaacttcttatttctcgtcctgtctctttgcaaagtatgggcttttgtttttgttttttaagggaaacgaaatggaattcgaagggaccttttcactaaccccacttctgtgtgttctgcatggtgcctgccccagggcatctgccaactccagtatcagctctcacagtgtacttggtaccatccctgggctctgctggcgagacgaaacagctgtagagatgaaaacaggctgcagaggctggcacagcctggccggcttttctccatctggggacagtcctactccaagaacactgcacaccagctcctcacacagatcccacttactctttttttttttttcagagaccacagaccacagtgatttttcttttcccttgtttaattaggcaatacccttgttaattgccctttggcaactaacttaaccatgtgcttcccacacagtacatcaggaaaacttacagggcaatatttttaacttggggcaggaagaagggagcagcagagaattgactagatatagcacctattaaaagagaactcttgcttcttctgagatttttcaagctgtgctttgtgtgtgtgccagtagacttacgcaaggacagggtacaaacttagctggaagtctgcccaggctgaatgatctcttccctagagttgattgtcgggtacacagtgtgaacccccgaagacggaacctcacagtcttccatgttcccttcttaactgtcgtgtggctcgttgctaaatcatgacaatggctgcctatctgctgcttcttaggttgctgttgtacatggaaccaggactagagattttttcagatttatagacttaaaaaattagaattttattaccaggctttccttctcaccccttttttctgactttgccaagtaatttgttgacacgaaaattttggaggaaccaattgaaaacacacttccagtctagatgatgctttgtgtgatacattaagttcttattttggattaaaagaagttttccatttgatacctctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaaagtcagttttgtgtgtttttttttttttttatttgaagtgccaaattaactttagtcagaatgtgagcagatggctaagttctctcctccccagaatggattaacagctgcgtggaaagtgggggagagagtggatggagacttttagagatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttataccactcacctttctcccagcatgtactcactgtgggcagatgcaccaatacatggtaatcctcttactcattttaagacgtaggaaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcagtgctggctggctgtcttcagaactcttggaaatctttacacatgcgagtgctaaccactttgagcaaggctgccttcttgtagatgacttgctgttctttatgacagggatcagtggcatttgtttcctagcagtatttagcacctttttgccaccttggtgaacagaaaattgtattttcctgtctttcatggctgaaaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcaggagcatgttgatttcttggttaggttgcattataataacaagagtcagaacattaattcgaaacaacttgcagtatgcatttcttcacaccagtacattcttaagtgtacttgtttataaggaataacataaactaatctgtacctttatatatatgtgtgtgtacatatatacatatataaactgtatagtgtacatggtaatgatttattgctatgccccagatccttaatgtagttctcatcctccgcatgccctcagccacaagcgggtgactgactgttccctgatgatttggcccacctcctgtgtttggacctctagggaggagggttttggtcatactctccttatcctcgtgcacagaaatgctcagggtccccatgtgcctgttgttcagccctctctcttgttccctttctgagcatgtggtccttccccaggctgtgggacagctgccttcccacgaaagtgtaaagcagtattaagatcattactgcatgtgccctaaaaacccaagttttctattcccttaggacagaaaattgcatgtgaggtgggataatcgagtttcagtgacccacgtcagttacacattaaagccagaccccatgataaaattccacaaaatggaaataaaactcaaatttctttagcattgtgtaaataaatctgaatgtgtttaactttgtactggtaattttctgtatatttggaatatttgggttaaaaataaaacagactggactttgttacctgaaaaaaaaaaaaactaa

SEQ ID NO: 304899 - DNA, 6977 bp, Homo sapiens
cattcagctttggatcaaggagtaggaactctgtaggatctccttcttggtcctggttgagcagagtgagcgaaaccttcatgaagagtcttctctcatgcaatgtatagtcagacctttagcccctagagggatgttaaaatgacttatgcattggatatttcagtaagaagtatcagcagatttgatgaagtgtaatttatctggggaaaggttagtcttcatctgaagtttggttgggatgagagtagaaagctagccaggtatgacagatggctccaagggaatgcagtgttaacaattagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatcttcagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggataccacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatagctcttcagaggagctggacccagcatggatggtggaaccacagtacctcttacactccctgtggctccaacttcaggaaataaatttcccattgcgagggacccagctctgtttctgctgcttccatcaaagccaaaaggacctacactaaagaaatgcagggtgggggtggggaaccctgagcacttttttacaattggctctgagaaaaagggagacattttaaattctttaacttcttatttctcgtcctgtctctttgcaaagtatgggcttttgtttttgttttttaagggaaacgaaatggaattcgaagggaccttttcactaaccccacttctgtgtgttctgcatggtgcctgccccagggcatctgccaactccagtatcagctctcacagtgtacttggtaccatccctgggctctgctggcgagacgaaacagctgtagagatgaaaacaggctgcagaggctggcacagcctggccggcttttctccatctggggacagtcctactccaagaacactgcacaccagctcctcacacagatcccacttactctttttttttttttcagagaccacagaccacagtgatttttcttttcccttgtttaattaggcaatacccttgttaattgccctttggcaactaacttaaccatgtgcttcccacacagtacatcaggaaaacttacagggcaatatttttaacttggggcaggaagaagggagcagcagagaattgactagatatagcacctattaaaagagaactcttgcttcttctgagatttttcaagctgtgctttgtgtgtgtgccagtagacttacgcaaggacagggtacaaacttagctggaagtctgcccaggctgaatgatctcttccctagagttgattgtcgggtacacagtgtgaacccccgaagacggaacctcacagtcttccatgttcccttcttaactgtcgtgtggctcgttgctaaatcatgacaatggctgcctatctgctgcttcttaggttgctgttgtacatggaaccaggactagagattttttcagatttatagacttaaaaaattagaattttattaccaggctttccttctcaccccttttttctgactttgccaagtaatttgttgacacgaaaattttggaggaaccaattgaaaacacacttccagtctagatgatgctttgtgtgatacattaagttcttattttggattaaaagaagttttccatttgatacctctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaaagtcagttttgtgtgtttttttttttttttatttgaagtgccaaattaactttagtcagaatgtgagcagatggctaagttctctcctccccagaatggattaacagctgcgtggaaagtgggggagagagtggatggagacttttagagatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttataccactcacctttctcccagcatgtactcactgtgggcagatgcaccaatacatggtaatcctcttactcattttaagacgtaggaaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcagtgctggctggctgtcttcagaactcttggaaatctttacacatgcgagtgctaaccactttgagcaaggctgccttcttgtagatgacttgctgttctttatgacagggatcagtggcatttgtttcctagcagtatttagcacctttttgccaccttggtgaacagaaaattgtattttcctgtctttcatggctgaaaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcaggagcatgttgatttcttggttaggttgcattataataacaagagtcagaacattaattcgaaacaacttgcagtatgcatttcttcacaccagtacattcttaagtgtacttgtttataaggaataacataaactaatctgtacctttatatatatgtgtgtgtacatatatacatatataaactgtatagtgtacatggtaatgatttattgctatgccccagatccttaatgtagttctcatcctccgcatgccctcagccacaagcgggtgactgactgttccctgatgatttggcccacctcctgtgtttggacctctagggaggagggttttggtcatactctccttatcctcgtgcacagaaatgctcagggtccccatgtgcctgttgttcagccctctctcttgttccctttctgagcatgtggtccttccccaggctgtgggacagctgccttcccacgaaagtgtaaagcagtattaagatcattactgcatgtgccctaaaaacccaagttttctattcccttaggacagaaaattgcatgtgaggtgggataatcgagtttcagtgacccacgtcagttacacattaaagccagaccccatgataaaattccacaaaatggaaataaaactcaaatttctttagcattgtgtaaataaatctgaatgtgtttaactttgtactggtaattttctgtatatttggaatatttgggttaaaaataaaacagactggactttgttacctgaaaaaaaaaaaaactaa

SEQ ID NO: 304900 - DNA, 6917 bp, Homo sapiens
  misc_feature (1)..(1): n is a, c, g, or t
nggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggataccacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatagctcttcagaggagctggacccagcatggatggtggaaccacagtacctcttacactccctgtggctccaacttcaggaaataaatttcccattgcgagggacccagctctgtttctgctgcttccatcaaagccaaaaggacctacactaaagaaatgcagggtgggggtggggaaccctgagcacttttttacaattggctctgagaaaaagggagacattttaaattctttaacttcttatttctcgtcctgtctctttgcaaagtatgggcttttgtttttgttttttaagggaaacgaaatggaattcgaagggaccttttcactaaccccacttctgtgtgttctgcatggtgcctgccccagggcatctgccaactccagtatcagctctcacagtgtacttggtaccatccctgggctctgctggcgagacgaaacagctgtagagatgaaaacaggctgcagaggctggcacagcctggccggcttttctccatctggggacagtcctactccaagaacactgcacaccagctcctcacacagatcccacttactctttttttttttttcagagaccacagaccacagtgatttttcttttcccttgtttaattaggcaatacccttgttaattgccctttggcaactaacttaaccatgtgcttcccacacagtacatcaggaaaacttacagggcaatatttttaacttggggcaggaagaagggagcagcagagaattgactagatatagcacctattaaaagagaactcttgcttcttctgagatttttcaagctgtgctttgtgtgtgtgccagtagacttacgcaaggacagggtacaaacttagctggaagtctgcccaggctgaatgatctcttccctagagttgattgtcgggtacacagtgtgaacccccgaagacggaacctcacagtcttccatgttcccttcttaactgtcgtgtggctcgttgctaaatcatgacaatggctgcctatctgctgcttcttaggttgctgttgtacatggaaccaggactagagattttttcagatttatagacttaaaaaattagaattttattaccaggctttccttctcaccccttttttctgactttgccaagtaatttgttgacacgaaaattttggaggaaccaattgaaaacacacttccagtctagatgatgctttgtgtgatacattaagttcttattttggattaaaagaagttttccatttgatacctctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaaagtcagttttgtgtgtttttttttttttttatttgaagtgccaaattaactttagtcagaatgtgagcagatggctaagttctctcctccccagaatggattaacagctgcgtggaaagtgggggagagagtggatggagacttttagagatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttataccactcacctttctcccagcatgtactcactgtgggcagatgcaccaatacatggtaatcctcttactcattttaagacgtaggaaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcagtgctggctggctgtcttcagaactcttggaaatctttacacatgcgagtgctaaccactttgagcaaggctgccttcttgtagatgacttgctgttctttatgacagggatcagtggcatttgtttcctagcagtatttagcacctttttgccaccttggtgaacagaaaattgtattttcctgtctttcatggctgaaaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcaggagcatgttgatttcttggttaggttgcattataataacaagagtcagaacattaattcgaaacaacttgcagtatgcatttcttcacaccagtacattcttaagtgtacttgtttataaggaataacataaactaatctgtacctttatatatatgtgtgtgtacatatatacatatataaactgtatagtgtacatggtaatgatttattgctatgccccagatccttaatgtagttctcatcctccgcatgccctcagccacaagcgggtgactgactgttccctgatgatttggcccacctcctgtgtttggacctctagggaggagggttttggtcatactctccttatcctcgtgcacagaaatgctcagggtccccatgtgcctgttgttcagccctctctcttgttccctttctgagcatgtggtccttccccaggctgtgggacagctgccttcccacgaaagtgtaaagcagtattaagatcattactgcatgtgccctaaaaacccaagttttctattcccttaggacagaaaattgcatgtgaggtgggataatcgagtttcagtgacccacgtcagttacacattaaagccagaccccatgataaaattccacaaaatggaaataaaactcaaatttctttagcattgtgtaaataaatctgaatgtgtttaactttgtactggtaattttctgtatatttggaatatttgggttaaaaataaaacagactggactttgttacctgaaaaaaaaaaaaactaa

SEQ ID NO: 304901 - DNA, 6527 bp, Homo sapiens
  misc_feature (435)..(435): n is a, c, g, or t
  misc_feature (897)..(897): n is a, c, g, or t
gtgtcacaagcaaaccctaacctcactgccaaacaaagatgctggcattatgctaagaaataaggggaatggccaggcgcggtggctcatgcctgtaatcctagcactttgagaggccaagataggcagatcacgaggtcaggagttcgaaaccagcctggccaacagggcgaaactccatctctactaaaaatagaaaaattagccaggtaaggtggcgggtgcctgtaaggtggcgggtcccagctagttgggaggctgaggcaggagaatcatttgaacctgagaggaagaggttgcaatgagccaagatcatgccattgcactccagcctgggcgacaagagcaagactctgtctcaaaaaaaaagaagggggataaagaaaaacactggaaaaaggatgacctgtagttaagtgttggcataatacaatnaaagacttaacgtttctagacactctagttgaatttggtcctttgagactgtcgtgggctcatttcctcagcgtgttgatttagtgactcctgaaggagcagacccttggtttggacctcacttttccataagacgttcaaatagatttaatgcctgagggtcgctgtcatctaaatccattcagtagactgtacagaagctggcttgggagttctcccctcagcaggcagctcccagttacccctaaagtgtaatgtcattaaaagatttgttaagcacctgctctttagcaggctgtatgctggtcttcatatcccaaaggataaaacctaatccactgtctttaggtcacagcctttgagtcatttttccagtagatgatacgacatactaagccagaaactaggtttatcagcaatatgcatttgagagccggtcaactgagctagaagtctaggaanaggatgttttcccttcttccttaagccaatgaacacatggtgaaattgaacctgtgctcttggctaattagtatcttgtcctaaacaaagagctccctggtcctgagtggagaatatctggttgcttacctctgacagctcctactgactgagggcgtaggtgtgcaagacacacacagcagcctcttagtttggaaggaacttgagagattttctatccagcttcccacttcaaaacaaatagggtttttcctaatcctcagatggatgttgagatggaaggaatactcttttggcatgaggaaatgcgattgctagtaggctctagactagtgtaactttttgtttgcaattccaaaatgaaggaataggttgagtcagacattcccactttccctctccttgttcttcctatagcctggcagctgcctcccgtgggtgggttctgtgctgtgtactttcctgaacagtgtgtctctcctttaggtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatagctcttcagaggagctggacccagcatggatggtggaaccacagtacctcttacactccctgtggctccaacttcaggaaataaatttcccattgcgagggacccagctctgtttctgctgcttccatcaaagccaaaaggacctacactaaagaaatgcagggtgggggtggggaaccctgagcacttttttacaattggctctgagaaaaagggagacattttaaattctttaacttcttatttctcgtcctgtctctttgcaaagtatgggcttttgtttttgttttttaagggaaacgaaatggaattcgaagggaccttttcactaaccccacttctgtgtgttctgcatggtgcctgccccagggcatctgccaactccagtatcagctctcacagtgtacttggtaccatccctgggctctgctggcgagacgaaacagctgtagagatgaaaacaggctgcagaggctggcacagcctggccggcttttctccatctggggacagtcctactccaagaacactgcacaccagctcctcacacagatcccacttactctttttttttttttcagagaccacagaccacagtgatttttcttttcccttgtttaattaggcaatacccttgttaattgccctttggcaactaacttaaccatgtgcttcccacacagtacatcaggaaaacttacagggcaatatttttaacttggggcaggaagaagggagcagcagagaattgactagatatagcacctattaaaagagaactcttgcttcttctgagatttttcaagctgtgctttgtgtgtgtgccagtagacttacgcaaggacagggtacaaacttagctggaagtctgcccaggctgaatgatctcttccctagagttgattgtcgggtacacagtgtgaacccccgaagacggaacctcacagtcttccatgttcccttcttaactgtcgtgtggctcgttgctaaatcatgacaatggctgcctatctgctgcttcttaggttgctgttgtacatggaaccaggactagagattttttcagatttatagacttaaaaaattagaattttattaccaggctttccttctcaccccttttttctgactttgccaagtaatttgttgacacgaaaattttggaggaaccaattgaaaacacacttccagtctagatgatgctttgtgtgatacattaagttcttattttggattaaaagaagttttccatttgatacctctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaaagtcagttttgtgtgtttttttttttttttatttgaagtgccaaattaactttagtcagaatgtgagcagatggctaagttctctcctccccagaatggattaacagctgcgtggaaagtgggggagagagtggatggagacttttagagatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttataccactcacctttctcccagcatgtactcactgtgggcagatgcaccaatacatggtaatcctcttactcattttaagacgtaggaaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcagtgctggctggctgtcttcagaactcttggaaatctttacacatgcgagtgctaaccactttgagcaaggctgccttcttgtagatgacttgctgttctttatgacagggatcagtggcatttgtttcctagcagtatttagcacctttttgccaccttggtgaacagaaaattgtattttcctgtctttcatggctgaaaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcaggagcatgttgatttcttggttaggttgcattataataacaagagtcagaacattaattcgaaacaacttgcagtatgcatttcttcacaccagtacattcttaagtgtacttgtttataaggaataacataaactaatctgtacctttatatatatgtgtgtgtacatatatacatatataaactgtatagtgtacatggtaatgatttattgctatgccccagatccttaatgtagttctcatcctccgcatgccctcagccacaagcgggtgactgactgttccctgatgatttggcccacctcctgtgtttggacctctagggaggagggttttggtcatactctccttatcctcgtgcacagaaatgctcagggtccccatgtgcctgttgttcagccctctctcttgttccctttctgagcatgtggtccttccccaggctgtgggacagctgccttcccacgaaagtgtaaagcagtattaagatcattactgcatgtgccctaaaaacccaagttttctattcccttaggacagaaaattgcatgtgaggtgggataatcgagtttcagtgacccacgtcagttacacattaaagccagaccccatgataaaattccacaaaatggaaataaaactcaaatttctttagcattgtgtaaataaatctgaatgtgtttaactttgtactggtaattttctgtatatttggaatatttgggttaaaaataaaacagactggactttgttacctgaaaaaaaaaaaaactaa

SEQ ID NO: 304902 - DNA, 3343 bp, Homo sapiens
gacgggcaccaacgcctgggcaacgagcgccaaactctttccccaaaaccacccaccccaaaaagccccactccgtgatagtttgactaggctaaaaagtggtgtaggtgtgaaagtcttttttgtttattttaatctggggtttgttgagcttcttgtttctgtagattaaagcctttcatcaccctttgggaagtttttgacccttaattcttcaaataattttactgtccccttactccctttgagactttggatccaaccaccaccaaaagaccgtatgtctgttctttccccattattctgtggtcaaagcaatcataatccaaattcttcgccatttattttgtggctagaaagtcagttttgtgtgtttttttttttttttatttgaagtgccaaattaactttagtcagaatgtgagcagatggctaagttctctcctccccagaatggattaacagctgcgtggaaagtgggggagagagtggatggagacttttagagatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttataccactcacctttctcccagcatgtactcactgtgggcagatgcaccaatacatggtaatcctcttactcattttaagacgtaggaaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcagtgctggctggctgtcttcagaactcttggaaatctttacacatgcgagtgctaaccactttgagcaaggctgccttcttgtagatgacttgctgttctttatgacagggatcagtggcatttgtttcctagcagtatttagcacctttttgccaccttggtgaacagaaaattgtattttcctgtctttcatggctgaaaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcaggagcatgttgatttcttggttaggttgcattataataacaagagtcagaacattaattcgaaacaacttgcagtatgcatttcttcacaccagtacattcttaagtgtacttgtttataaggaataacataaactaatctgtacctttatatatatgtgtgtgtacatatatacatatataaactgtatagtgtacatggtaatgatttattgctatgccccagatccttaatgtagttctcatcctccgcatgccctcagccacaagcgggtgactgactgttccctgatgatttggcccacctcctgtgtttggacctctagggaggagggttttggtcatactctccttatcctcgtgcacagaaatgctcagggtccccatgtgcctgttgttcagccctctctcttgttccctttctgagcatgtggtccttccccaggctgtgggacagctgccttcccacgaaagtgtaaagcagtattaagatcattactgcatgtgccctaaaaacccaagttttctattcccttaggacagaaaattgcatgtgaggtgggataatcgagtttcagtgacccacgtcagttacacattaaagccagaccccatgataaaattccacaaaatggaaataaaactcaaatttctttagcattgtgtaaataaatctgaatgtgtttaactttgtactggtaattttctgtatatttggaatatttgggttaaaaataaaacagactggactttgttacctgaaaaaaaaaaaaactaa

SEQ ID NO: 304903 - DNA, 6683 bp, Homo sapiens
  misc_feature (1)..(1): n is a, c, g, or t
nggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatcttcagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggataccacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatagctcttcagaggagctggacccagcatggatggtggaaccacagtacctcttacactccctgtggctccaacttcaggaaataaatttcccattgcgagggacccagctctgtttctgctgcttccatcaaagccaaaaggacctacactaaagaaatgcagggtgggggtggggaaccctgagcacttttttacaattggctctgagaaaaagggagacattttaaattctttaacttcttatttctcgtcctgtctctttgcaaagtatgggcttttgtttttgttttttaagggaaacgaaatggaattcgaagggaccttttcactaaccccacttctgtgtgttctgcatggtgcctgccccagggcatctgccaactccagtatcagctctcacagtgtacttggtaccatccctgggctctgctggcgagacgaaacagctgtagagatgaaaacaggctgcagaggctggcacagcctggccggcttttctccatctggggacagtcctactccaagaacactgcacaccagctcctcacacagatcccacttactctttttttttttttcagagaccacagaccacagtgatttttcttttcccttgtttaattaggcaatacccttgttaattgccctttggcaactaacttaaccatgtgcttcccacacagtacatcaggaaaacttacagggcaatatttttaacttggggcaggaagaagggagcagcagagaattgactagatatagcacctattaaaagagaactcttgcttcttctgagatttttcaagctgtgctttgtgtgtgtgccagtagacttacgcaaggacagggtacaaacttagctggaagtctgcccaggctgaatgatctcttccctagagttgattgtcgggtacacagtgtgaacccccgaagacggaacctcacagtcttccatgttcccttcttaactgtcgtgtggctcgttgctaaatcatgacaatggctgcctatctgctgcttcttaggttgctgttgtacatggaaccaggactagagattttttcagatttatagacttaaaaaattagaattttattaccaggctttccttctcaccccttttttctgactttgccaagtaatttgttgacacgaaaattttggaggaaccaattgaaaacacacttccagtctagatgatgctttgtgtgatacattaagttcttattttggattaaaagaagttttccatttgatacctctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaaagtcagttttgtgtgtttttttttttttttatttgaagtgccaaattaactttagtcagaatgtgagcagatggctaagttctctcctccccagaatggattaacagctgcgtggaaagtgggggagagagtggatggagacttttagagatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttataccactcacctttctcccagcatgtactcactgtgggcagatgcaccaatacatggtaatcctcttactcattttaagacgtaggaaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcagtgctggctggctgtcttcagaactcttggaaatctttacacatgcgagtgctaaccactttgagcaaggctgccttcttgtagatgacttgctgttctttatgacagggatcagtggcatttgtttcctagcagtatttagcacctttttgccaccttggtgaacagaaaattgtattttcctgtctttcatggctgaaaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcaggagcatgttgatttcttggttaggttgcattataataacaagagtcagaacattaattcgaaacaacttgcagtatgcatttcttcacaccagtacattcttaagtgtacttgtttataaggaataacataaactaatctgtacctttatatatatgtgtgtgtacatatatacatatataaactgtatagtgtacatggtaatgatttattgctatgccccagatccttaatgtagttctcatcctccgcatgccctcagccacaagcgggtgactgactgttccctgatgatttggcccacctcctgtgtttggacctctagggaggagggttttggtcatactcttccgattccctggcccgggtttttcccccaggaaacagcgattgccattaatcggcttctccctgccgtcgtt

SEQ ID NO: 304904 - DNA, 5686 bp, Homo sapiens
  misc_feature (1)..(1): n is a, c, g, or t
nggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatcttcagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggataccacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatagctcttcagaggagctggacccagcatggatggtggaaccacagtacctcttacactccctgtggctccaacttcaggaaataaatttcccattgcgagggacccagctctgtttctgctgcttccatcaaagccaaaaggacctacactaaagaaatgcagggtgggggtggggaaccctgagcacttttttacaattggctctgagaaaaagggagacattttaaattctttaacttcttatttctcgtcctgtctctttgcaaagtatgggcttttgtttttgttttttaagggaaacgaaatggaattcgaagggaccttttcactaaccccacttctgtgtgttctgcatggtgcctgccccagggcatctgccaactccagtatcagctctcacagtgtacttggtaccatccctgggctctgctggcgagacgaaacagctgtagagatgaaaacaggctgcagaggctggcacagcctggccggcttttctccatctggggacagtcctactccaagaacactgcacaccagctcctcacacagatcccacttactctttttttttttttcagagaccacagaccacagtgatttttcttttcccttgtttaattaggcaatacccttgttaattgccctttggcaactaacttaaccatgtgcttcccacacagtacatcaggaaaacttacagggcaatatttttaacttggggcaggaagaagggagcagcagagaattgactagatatagcacctattaaaagagaactcttgcttcttctgagatttttcaagctgtgctttgtgtgtgtgccagtagacttacgcaaggacagggtacaaacttagctggaagtctgcccaggctgaatgatctcttccctagagttgattgtcgggtacacagtgtgaacccccgaagacggaacctcacagtcttccatgttcccttcttaactgtcgtgtggctcgttgctaaatcatgacaatggctgcctatctgctgcttcttaggttgctgttgtacatggaaccaggactagagattttttcagatttatagacttaaaaaattagaattttattaccaggctttccttctcaccccttttttctgactttgccaagtaatttgttgacacgaaaattttggaggaaccaattgaaaacacacttccagtctagatgatgctttgtgtgatacattaagttcttattttggattaaaagaagttttccatttgatacctctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaaagtcagttttgtgtgtttttttttttttttatttgaagtgccaaattaactttagtcagaatgtgagcagatggctaagttctctcctccccagaatggattaacagctgcgtggaaagtgggggagagagtggatggagacttttagagatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttataccactcacctttctcccagcatgtactcactgtgggcagatgcaccaatacatggtaatcctcttactcattttaagacgtaggaaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcagtgctggctggctgtcttcagaactcttggaaatctttacacatgcgagtgctaaccactttgagcaaggctgccttcttgtagatgacttgctgttctttatgacagggatcagtggcatttgtttcctagcagtatttagcacctttttgccaccttggtgaacagaaaattgtattttcctgtctttcatggctgaaaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgcttgagctccctgatggcctcacatgccaagtcggtaccgagctgattgtatcata

SEQ ID NO: 304905 - DNA, 2657 bp, Homo sapiens
  misc_feature (1)..(1): n is a, c, g, or t
nggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatcttcagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggataccacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatagctcttcagaggagctggacccagcatggatggtggaaccacagtacctcttacactccctgtggctccaacttcaggaaataaatttcccattgcgaggga

SEQ ID NO: 304906 - DNA, 1238 bp, Homo sapiens
  misc_feature (1)..(1): n is a, c, g, or t
nggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatcttcagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatgcccatgtgcctgttgttcagccctctctcttgttccctttctgagcatgtggtccttccccaggctgtgggacagctgccttcccacgaaagtgtaaagcagtattaagatcattactgcatgtgccctaaaaacccaagttttctattcccttaggacagaaaattgcatgtgaggtgggataatcgagtttcagtgacccacgtcagttacacattaaagccagaccccatgataaaattccacaaaatggaaataaaactcaaatttctttagcattgtgtaaataaatctgaatgtgtttaactttgtactggtaattttctgtatatttggaatatttgggttaaaaataaaacagactggactttgttacctgaaaaaaaaaaaaactaa

SEQ ID NO: 304907 - DNA, 1398 bp, Homo sapiens
  misc_feature (1)..(1): n is a, c, g, or t
nggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatcttcagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggataccacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttgtgacgaagggggatgacacgaaatcctcgagagtcacctcaccatc

SEQ ID NO: 304908 - DNA, 1044 bp, Homo sapiens
  misc_feature (1)..(1): n is a, c, g, or t
nggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaaggtgagatcaataacacgcgttggagcatttcactaagtaacattgagaatatagattctcccttttctagacatgatggcacgtaacagttgatgtaaaagatcttctagccatcctaagttttcaccagactgtcacactcagcacatgtttttgttgttgttgttgttgttgttttttgagacagggtctcactcttgtcacccaggctggagtgcagtggcgtcatcttggctcactgcagcctccacctcccaggctcaagccatcctcccacttcagcctcccaggtagctgggactgcaggcacacgctaccatgcccagctaattttttgtattttttgtagagacagggtttccccatgttgcctaggcttgtattgagctcctgggttcgaatgatccacctgcctccaaaagtgctgggattataggcgggagccactgcacccggcccttagcacactttttaacgtctactctttttttttttttgagcagggtctagctctgtcactcaggctggagagcagtggcgcaaa

SEQ ID NO: 304909 - DNA, 6914 bp, Homo sapiens
  misc_feature (1)..(1): n is a, c, g, or t
nggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatcttcagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggataccacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggacctcttggaatagctcttcagaggagctggacccagcatggatggtggaaccacagtacctcttacactccctgtggctccaacttcaggaaataaatttcccattgcgagggacccagctctgtttctgctgcttccatcaaagccaaaaggacctacactaaagaaatgcagggtgggggtggggaaccctgagcacttttttacaattggctctgagaaaaagggagacattttaaattctttaacttcttatttctcgtcctgtctctttgcaaagtatgggcttttgtttttgttttttaagggaaacgaaatggaattcgaagggaccttttcactaaccccacttctgtgtgttctgcatggtgcctgccccagggcatctgccaactccagtatcagctctcacagtgtacttggtaccatccctgggctctgctggcgagacgaaacagctgtagagatgaaaacaggctgcagaggctggcacagcctggccggcttttctccatctggggacagtcctactccaagaacactgcacaccagctcctcacacagatcccacttactctttttttttttttcagagaccacagaccacagtgatttttcttttcccttgtttaattaggcaatacccttgttaattgccctttggcaactaacttaaccatgtgcttcccacacagtacatcaggaaaacttacagggcaatatttttaacttggggcaggaagaagggagcagcagagaattgactagatatagcacctattaaaagagaactcttgcttcttctgagatttttcaagctgtgctttgtgtgtgtgccagtagacttacgcaaggacagggtacaaacttagctggaagtctgcccaggctgaatgatctcttccctagagttgattgtcgggtacacagtgtgaacccccgaagacggaacctcacagtcttccatgttcccttcttaactgtcgtgtggctcgttgctaaatcatgacaatggctgcctatctgctgcttcttaggttgctgttgtacatggaaccaggactagagattttttcagatttatagacttaaaaaattagaattttattaccaggctttccttctcaccccttttttctgactttgccaagtaatttgttgacacgaaaattttggaggaaccaattgaaaacacacttccagtctagatgatgctttgtgtgatacattaagttcttattttggattaaaagaagttttccatttgatacctctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaaagtcagttttgtgtgtttttttttttttttatttgaagtgccaaattaactttagtcagaatgtgagcagatggctaagttctctcctccccagaatggattaacagctgcgtggaaagtgggggagagagtggatggagacttttagagatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttataccactcacctttctcccagcatgtactcactgtgggcagatgcaccaatacatggtaatcctcttactcattttaagacgtaggaaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcagtgctggctggctgtcttcagaactcttggaaatctttacacatgcgagtgctaaccactttgagcaaggctgccttcttgtagatgacttgctgttctttatgacagggatcagtggcatttgtttcctagcagtatttagcacctttttgccaccttggtgaacagaaaattgtattttcctgtctttcatggctgaaaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcaggagcatgttgatttcttggttaggttgcattataataacaagagtcagaacattaattcgaaacaacttgcagtatgcatttcttcacaccagtacattcttaagtgtacttgtttataaggaataacataaactaatctgtacctttatatatatgtgtgtgtacatatatacatatataaactgtatagtgtacatggtaatgatttattgctatgccccagatccttaatgtagttctcatcctccgcatgccctcagccacaagcgggtgactgactgttccctgatgatttggcccacctcctgtgtttggacctctagggaggagggttttggtcatactctccttatcctcgtgcacagaaatgctcagggtccccatgtgcctgttgttcagccctctctcttgttccctttctgagcatgtggtccttccccaggctgtgggacagctgccttcccacgaaagtgtaaagcagtattaagatcattactgcatgtgccctaaaaacccaagttttctattcccttaggacagaaaattgcatgtgaggtgggataatcgagtttcagtgacccacgtcagttacacattaaagccagaccccatgataaaattccacaaaatggaaataaaactcaaatttctttagcattgtgtaaataaatctgaatgtgtttaactttgtactggtaattttctgtatatttggaatatttgggttaaaaataaaacagactggactttgttacctgaaaaaaaaaaaaactaa

SEQ ID NO: 304910 - DNA, 6622 bp, Homo sapiens
tttccttatagtaatttccgactctccttggcctctttccagcccatgcctgttcccttcatcctggctattctgagagacttccttagagagaaggcgtgttacatcttgacttcccttgtgatctcccaaacatgggtttcatctctattttctagacccttaagtatataattctttaaattatgcaagcactgtatgaaagggaccaaacttttatgcagtagtcatcattttaagaattacctgagtgtatgcaaatggctataaagccaacctaatgttctcatcaaatccttagctctactgaaggaggtggactatcagagaccaagactatactatcttacagggccgcatcagaatgaagaattcaaagagaaagccaagatagccttacttagaatagaatggattgttcctttacctagaactttgctaggggctagaaattgctttggtaattggtactatgacctttcattcatagcaatcgtacccagtagagaaatggataatagtagttatttaaaacattcttgttcatgtccctgcccatggcatcttggcagaaaattagaaagataaatattgacatctgttctaggataccacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatagctcttcagaggagctggacccagcatggatggtggaaccacagtacctcttacactccctgtggctccaacttcaggaaataaatttcccattgcgagggacccagctctgtttctgctgcttccatcaaagccaaaaggacctacactaaagaaatgcagggtgggggtggggaaccctgagcacttttttacaattggctctgagaaaaagggagacattttaaattctttaacttcttatttctcgtcctgtctctttgcaaagtatgggcttttgtttttgttttttaagggaaacgaaatggaattcgaagggaccttttcactaaccccacttctgtgtgttctgcatggtgcctgccccagggcatctgccaactccagtatcagctctcacagtgtacttggtaccatccctgggctctgctggcgagacgaaacagctgtagagatgaaaacaggctgcagaggctggcacagcctggccggcttttctccatctggggacagtcctactccaagaacactgcacaccagctcctcacacagatcccacttactctttttttttttttcagagaccacagaccacagtgatttttcttttcccttgtttaattaggcaatacccttgttaattgccctttggcaactaacttaaccatgtgcttcccacacagtacatcaggaaaacttacagggcaatatttttaacttggggcaggaagaagggagcagcagagaattgactagatatagcacctattaaaagagaactcttgcttcttctgagatttttcaagctgtgctttgtgtgtgtgccagtagacttacgcaaggacagggtacaaacttagctggaagtctgcccaggctgaatgatctcttccctagagttgattgtcgggtacacagtgtgaacccccgaagacggaacctcacagtcttccatgttcccttcttaactgtcgtgtggctcgttgctaaatcatgacaatggctgcctatctgctgcttcttaggttgctgttgtacatggaaccaggactagagattttttcagatttatagacttaaaaaattagaattttattaccaggctttccttctcaccccttttttctgactttgccaagtaatttgttgacacgaaaattttggaggaaccaattgaaaacacacttccagtctagatgatgctttgtgtgatacattaagttcttattttggattaaaagaagttttccatttgatacctctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaaagtcagttttgtgtgtttttttttttttttatttgaagtgccaaattaactttagtcagaatgtgagcagatggctaagttctctcctccccagaatggattaacagctgcgtggaaagtgggggagagagtggatggagacttttagagatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttataccactcacctttctcccagcatgtactcactgtgggcagatgcaccaatacatggtaatcctcttactcattttaagacgtaggaaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcagtgctggctggctgtcttcagaactcttggaaatctttacacatgcgagtgctaaccactttgagcaaggctgccttcttgtagatgacttgctgttctttatgacagggatcagtggcatttgtttcctagcagtatttagcacctttttgccaccttggtgaacagaaaattgtattttcctgtctttcatggctgaaaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcaggagcatgttgatttcttggttaggttgcattataataacaagagtcagaacattaattcgaaacaacttgcagtatgcatttcttcacaccagtacattcttaagtgtacttgtttataaggaataacataaactaatctgtacctttatatatatgtgtgtgtacatatatacatatataaactgtatagtgtacatggtaatgatttattgctatgccccagatccttaatgtagttctcatcctccgcatgccctcagccacaagcgggtgactgactgttccctgatgatttggcccacctcctgtgtttggacctctagggaggagggttttggtcatactctccttatcctcgtgcacagaaatgctcagggtccccatgtgcctgttgttcagccctctctcttgttccctttctgagcatgtggtccttccccaggctgtgggacagctgccttcccacgaaagtgtaaagcagtattaagatcattactgcatgtgccctaaaaacccaagttttctattcccttaggacagaaaattgcatgtgaggtgggataatcgagtttcagtgacccacgtcagttacacattaaagccagaccccatgataaaattccacaaaatggaaataaaactcaaatttctttagcattgtgtaaataaatctgaatgtgtttaactttgtactggtaattttctgtatatttggaatatttgggttaaaaataaaacagactggactttgttacctgaaaaaaaaaaaaactaa

SEQ ID NO: 304911 - DNA, 6334 bp, Homo sapiens
  misc_feature (1)..(1): n is a, c, g, or t
  misc_feature (6324)..(6324): n is a, c, g, or t
nggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatcttcagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggataccacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatagctcttcagaggagctggacccagcatggatggtggaaccacagtacctcttacactccctgtggctccaacttcaggaaataaatttcccattgcgagggacccagctctgtttctgctgcttccatcaaagccaaaaggacctacactaaagaaatgcagggtgggggtggggaaccctgagcacttttttacaattggctctgagaaaaagggagacattttaaattctttaacttcttatttctcgtcctgtctctttgcaaagtatgggcttttgtttttgttttttaagggaaacgaaatggaattcgaagggaccttttcactaaccccacttctgtgtgttctgcatggtgcctgccccagggcatctgccaactccagtatcagctctcacagtgtacttggtaccatccctgggctctgctggcgagacgaaacagctgtagagatgaaaacaggctgcagaggctggcacagcctggccggcttttctccatctggggacagtcctactccaagaacactgcacaccagctcctcacacagatcccacttactctttttttttttttcagagaccacagaccacagtgatttttcttttcccttgtttaattaggcaatacccttgttaattgccctttggcaactaacttaaccatgtgcttcccacacagtacatcaggaaaacttacagggcaatatttttaacttggggcaggaagaagggagcagcagagaattgactagatatagcacctattaaaagagaactcttgcttcttctgagatttttcaagctgtgctttgtgtgtgtgccagtagacttacgcaaggacagggtacaaacttagctggaagtctgcccaggctgaatgatctcttccctagagttgattgtcgggtacacagtgtgaacccccgaagacggaacctcacagtcttccatgttcccttcttaactgtcgtgtggctcgttgctaaatcatgacaatggctgcctatctgctgcttcttaggttgctgttgtacatggaaccaggactagagattttttcagatttatagacttaaaaaattagaattttattaccaggctttccttctcaccccttttttctgactttgccaagtaatttgttgacacgaaaattttggaggaaccaattgaaaacacacttccagtctagatgatgctttgtgtgatacattaagttcttattttggattaaaagaagttttccatttgatacctctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaaagtcagttttgtgtgtttttttttttttttatttgaagtgccaaattaactttagtcagaatgtgagcagatggctaagttctctcctccccagaatggattaacagctgcgtggaaagtgggggagagagtggatggagacttttagagatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttataccactcacctttctcccagcatgtactcactgtgggcagatgcaccaatacatggtaatcctcttactcattttaagacgtaggaaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcagtgctggctggctgtcttcagaactcttggaaatctttacacatgcgagtgctaaccactttgagcaaggctgccttcttgtagatgacttgctgttctttatgacagggatcagtggcatttgtttcctagcagtatttagcacctttttgccaccttggtgaacagaaaattgtattttcctgtctttcatggctgaaaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcaggagcatgttgatttcttggttaggttgcattataataacaatcgagacatagcgggatcctntagatcaacc

SEQ ID NO: 304912 - DNA, 1896 bp, Homo sapiens
  misc_feature (1)..(1): n is a, c, g, or t
nggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatcttcagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggataccacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagtatgcatgaactcatctcacacacactgtctgcatagagggcaactgggggaatgttcttcagtttattggggggatgttacagactataattcaaatttttgcatttgacagaactatagataagattctagaaaggattgcttttaattggcaactcagattaaatggcattgttttttcttctgactgc

SEQ ID NO: 304913 - DNA, 1164 bp, Homo sapiens
  misc_feature (1)..(1): n is a, c, g, or t
nggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatcttcagatcatcagattttgcgaagaattttgtgcaaacagatctcccttttcatcctctcactcagatgatgtatagccctcagaattctgattatcttttagctctcagcactgaacccatgtgcctgttgttcagccctctctcttgttccctttctgagcatgtggtccttccccaggctgtgggacagctgccttcccacgaaagtgtaaagcagtattaagatcattactgcatgtgccctaaaaacccaagttttctattcccttaggacagaaaattgcatgtgaggtgggataatcgagtttcagtgacccacgtcagttacacattaaagccagaccccatgataaaattccacaaaatggaaataaaactcaaatttctttagcattgtgtaaataaatctgaatgtgtttaactttgtactggtaattttctgtatatttggaatatttgggttaaaaataaaacagactggactttgttacctgaaaaaaaaaaaaactaa

SEQ ID NO: 304914 - DNA, 769 bp, Homo sapiens
  misc_feature (1)..(1): n is a, c, g, or t
nggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtgtgttgagggactgtggtgcccatgggctcatggttgttcatctgttggtccctgcccctgccacaaaggaggtactgccaggattgggggaatggaaggaggatcagtcagctccttatccctcctgatatacagctgggctcccactaggaggacacgctgaggatacattggcccctggtcttaaatcaggacttgttgcctggctgtcttattatcctgcttgaacaagagcaggggcaacatctcctgccccctggtattccataatgcatgtgtcatagcattgaggcacatgatagttatattagaagcctaaagaaataaaatcttggtgctg

SEQ ID NO: 304915 - DNA, 1360 bp, Homo sapiens
aaatctggactctaattctgtaatatatcaaggaatctcgtaaaaccgacactaaaacgtccctgcctacaaatcatccggccaaattatgagttcattgtattatgcgaatgctttattttctaaatatccagcctcaagttcggttttcgctaccggagccttcccagaacaaacttcttgtgcgtttgcttccaacccccagcgcccgggctatggagcgggttcgggcgcttccttcgccgcctcgatgcagggcttgtaccccggcggggggggcatggcgggccagagcgcggccggcgtctacgcggccggctatgggctcgagccgagttccttcaacatgcactgcgcgccctttgagcagaacctctccggggtgtgtcccggcgactccgccaaggcggcgggcgccaaggagcagagggactcggacttggcggccgagagtaacttccggatctacccctggatgcgaagctcaggaactgaccgcaaacgaggccgccagacctacacccgctaccagaccctggagctggagaaagaatttcactacaatcgctacctgacgcggcggcggcgcatcgagatcgcgcacacgctctgcctcacggaaagacagatcaagatttggtttcagaaccggcgcatgaagtggaaaaaggagaacaagaccgcgggcccggggaccaccggccaagacagggctgaagcagaggaggaagaggaagagtgagggatggagaaagggcagaggaagagacatgagaaagggagaggaagagaagcccagctctgggaactgaatcaggaaactcaaatcgaatagggaagtaaaaaaacaaaacaaaaaacaaaaaaaaacaaaaaaaaaaccctatttaaatgaaaggagtttaaaaacattttttaaggagggagaaaggagaaattttggtttttcaacactgaaaaaatactacctataggaaagtctgtcaggtttggtttttttgtacaatatgaaaaggatattatctacctgttctgtagctttctggaatttacctccccttttctatgttgctattgtaaggtctttgtaaaatcttgcagttttgtaagccctctttaatgctgtctttgtggactgtgggtctggactaaccctgtggttgcctgccctcctgagcctccgccttcccagcagcggcaccaaggggccttagggagccccaaaacctaccactcgcgtgttccccaagcgcctggctgctgcttcttgcttcccgtcccccagccccatgctcccttttacattctgtgtgtatctaaaggatggaaaaataaaacgcaattaaaaataaaaaaaaaa

SEQ ID NO: 304916 - DNA, 706 bp, Homo sapiens
aaatctggactctaattctgtaatatatcaaggaatctcgtaaaaccgacactaaaacgtccctgcctacaaatcatccggccaaattatgagttcattgtattatgcgaatgctttattttctaaatatccagcctcaagttcggttttcgctaccggagccttcccagaacaaacttcttgtgcgtttgcttccaacccccagcgcccgggctatggagcgggttcgggcgcttccttcgccgcctcgatgcagggcttgtaccccggcggggggggcatggcgggccagagcgcggccggcgtctacgcggccggctatgggctcgagccgagttccttcaacatgcactgcgcgccctttgagcagaacctctccggggtgtgtcccggcgactccgccaaggcggcgggcgccaaggagcagagggactcggacttggcggccgagagtaacttccggatctacccctggatgcgaagctcaggtaacgccgcgcaccgagctgtcctgagccccaggggccggggcacattaccctgaaggcgcctccttcccggctgggcgcccctttccgcgtccagagtgctcccagccggaggtcggccctggaaggctgcacccactgggccgcgacccagcaggccatccccgcccccatatttgctcggtgctctcaggctcgctctgcttcccggcggatct

SEQ ID NO: 304917 - DNA, 1411 bp, Homo sapiens
ggccgagccgatcatagggtctgcgcggggctctgtggattttccgtgtaggcggcggcttccagtctctgccgggcgcgggctgggtcagcgccgactcctccgagagaagagcgcgcctggcggccggttcggcggaggccaagtcccgggggctggggctgcttctctccacgcggacaaagtgtgcgggcaaagaaaggggccgaggcgggtgcttctgccgctcgtaaatttgtttccccttccttttaatccgcccccggacgtctttcttttcaggacaggaggggatgtaaaccgtttgaagttcatcaacacggtgaagttttattgtatttccggtccccaagatttatacccgggagggggagcgggcggccaggtggactccctcgctacctcggacttccctgccggacacgtggccactcggaccctcgcttctgggcgagggcgggagggagcctggactgggccgcggccgctggctccgcaccttccgacggccgcgcactgccggcaccgccgccgcccaggaactgaccgcaaacgaggccgccagacctacacccgctaccagaccctggagctggagaaagaatttcactacaatcgctacctgacgcggcggcggcgcatcgagatcgcgcacacgctctgcctcacggaaagacagatcaagatttggtttcagaaccggcgcatgaagtggaaaaaggagaacaagaccgcgggcccggggaccaccggccaagacagggctgaagcagaggaggaagaggaagagtgagggatggagaaagggcagaggaagagacatgagaaagggagaggaagagaagcccagctctgggaactgaatcaggaaactcaaatcgaatagggaagtaaaaaaacaaaacaaaaaacaaaaaaaaacaaaaaaaaaaccctatttaaatgaaaggagtttaaaaacattttttaaggagggagaaaggagaaattttggtttttcaacactgaaaaaatactacctataggaaagtctgtcaggtttggtttttttgtacaatatgaaaaggatattatctacctgttctgtagctttctggaatttacctccccttttctatgttgctattgtaaggtctttgtaaaatcttgcagttttgtaagccctctttaatgctgtctttgtggactgtgggtctggactaaccctgtggttgcctgccctcctgagcctccgccttcccagcagcggcaccaaggggccttagggagccccaaaacctaccactcgcgtgttccccaagcgcctggctgctgcttcttgcttcccgtcccccagccccatgctcccttttacattctgtgtgtatctaaaggatggaaaaataaaacgcaattaaaaataaaaaaaaaa

SEQ ID NO: 304918 - DNA, 1360 bp, Homo sapiens
  misc_feature (24)..(25): n is a, c, g, or t
ccacgcgtccgcggacgcgtgggnngacccacgaatctcgtaaaaccgacactaaaacgtccctgcctacaaatcatccggccaaattatgagttcattgtattatgcgaatgctttattttctaaatatccagcctcaagttcggttttcgctaccggagccttcccagaacaaacttcttgtgcgtttgcttccaacccccagcgcccgggctatggagcgggttcgggcgcttccttcgccgcctcgatgcagggcttgtaccccggcggggggggcatggcgggccagagcgcggccggcgtctacgcggccggctatgggctcgagccgagttccttcaacatgcactgcgcgccctttgagcagaacctctccggggtgtgtcccggcgactccgccaaggcggcgggcgccaaggagcagagggactcggacttggcggccgagagtaacttccggatctacccctggatgcgaagctcaggaactgaccgcaaacgaggccgccagacctacacccgctaccagaccctggagctggagaaagaatttcactacaatcgctacctgacgcggcggcggcgcatcgagatcgcgcacacgctctgcctcacggaaagacagatcaagatttggtttcagaaccggcgcatgaagtggaaaaaggagaacaagaccgcgggcccggggaccaccggccaagacagggctgaagcagaggaggaagaggaagagtgagggatggagaaagggcagaggaagagacatgagaaagggagaggaagagaagcccagctctgggaactgaatcaggaaactcaaatcgaatagggaagtaaaaaaacaaaacaaaaaacaaaaaaaaacaaaaaaaaaaccctatttaaatgaaaggagtttaaaaacattttttaaggagggagaaaggagaaattttggtttttcaacactgaaaaaatactacctataggaaagtctgtcaggtttggtttttttgtacaatatgaaaaggatattatctacctgttctgtagctttctggaatttacctccccttttctatgttgctattgtaaggtctttgtaaaatcttgcagttttgtaagccctctttaatgctgtctttgtggactgtgggtctggactaaccctgtggttgcctgccctcctgagcctccgccttcccagcagcggcaccaaggggccttagggagccccaaaacctaccactcgcgtgttccccaagcgcctggctgctgcttcttgcttcccgtcccccagccccatgctcccttttacattctgtgtgtatctaaaggatggaaaaataaaacgcaattaaaaataaaaaaaaaa

SEQ ID NO: 304919 - DNA, 1292 bp, Homo sapiens
aaatctggactctaattctgtaatatatcaaggaatctcgtaaaaccgacactaaaacgtccctgcctacaaatcatccggccaaattatgagttcattgtattatgcgaatgctttattttctaaatatccagcctcaagttcggttttcgctaccggagccttcccagaacaaacttcttgtgcgtttgcttccaacccccagcgcccgggctatggagcgggttcgggcgcttccttcgccgcctcgatgcagggcttgtaccccggcggggggggcatggcgggccagagcgcggccggcgtctacgcggccggctatgggctcgagccgagttccttcaacatgcactgcgcgccctttgagcagaacctctccggggtgtgtcccggcgactccgccaaggcggcgggcgccaaggagcagagggactcggacttggcggccgagagtaacttccggatctacccctggatgcgaagctcaggaactgaccgcaaacgaggccgccagacctacacccgctaccagaccctggagctggagaaagaatttcactacaatcgctacctgacgcggcggcggcgcatcgagatcgcgcacacgctctgcctcacggaaagacagatcaagatttggtttcagaaccggcgcatgaagtggaaaaaggagaacaagaccgcgggcccggggaccaccggccaagacagggctgaagcagaggaggaagaggaagagtgagggatggagaaagggcagaggaagagacatgagaaagggagaggaagagaagcccagctctgggaactgaatcaggaaactcaaatcgaatagggaagtaaaaaaacaaaacaaaaaacaaaaaaaaacaaaaaaaaaaccctatttaaatgaaaggagtttaaaaacattttttaaggagggagtttttgtacaatatgaaaaggatattatctacctgttctgtagctttctggaatttacctccccttttctatgttgctattgtaaggtctttgtaaaatcttgcagttttgtaagccctctttaatgctgtctttgtggactgtgggtctggactaaccctgtggttgcctgccctcctgagcctccgccttcccagcagcggcaccaaggggccttagggagccccaaaacctaccactcgcgtgttccccaagcgcctggctgctgcttcttgcttcccgtcccccagccccatgctcccttttacattctgtgtgtatctaaaggatggaaaaataaaacgcaattaaaaataaaaaaaaaa

SEQ ID NO: 304920 - DNA, 956 bp, Homo sapiens
agtgctgggattacaggtttgagcccaccgcgcccggccggcgttttctttactcactgattttcctctgaatactgtgtgcaggaactgaccgcaaacgaggccgccagacctacacccgctaccagaccctggagctggagaaagaatttcactacaatcgctacctgacgcggcggcggcgcatcgagatcgcgcacacgctctgcctcacggaaagacagatcaagatttggtttcagaaccggcgcatgaagtggaaaaaggagaacaagaccgcgggcccggggaccaccggccaagacagggctgaagcagaggaggaagaggaagagtgagggatggagaaagggcagaggaagagacatgagaaagggagaggaagagaagcccagctctgggaactgaatcaggaaactcaaatcgaatagggaagtaaaaaaacaaaacaaaaaacaaaaaaaaacaaaaaaaaaaccctatttaaatgaaaggagtttaaaaacattttttaaggagggagaaaggagaaattttggtttttcaacactgaaaaaatactacctataggaaagtctgtcaggtttggtttttttgtacaatatgaaaaggatattatctacctgttctgtagctttctggaatttacctccccttttctatgttgctattgtaaggtctttgtaaaatcttgcagttttgtaagccctctttaatgctgtctttgtggactgtgggtctggactaaccctgtggttgcctgccctcctgagcctccgccttcccagcagcggcaccaaggggccttagggagccccaaaacctaccactcgcgtgttccccaagcgcctggctgctgcttcttgcttcccgtcccccagccccatgctcccttttacattctgtgtgtatctaaaggatggaaaaataaaacgcaattaaaaataaaaaaaaaa

SEQ ID NO: 304921 - DNA, 1210 bp, Homo sapiens
cgcgcgggcagggggcggggactgtcgcgtggagctgccgggcgagcaccgttagggcagcctggcgcgcggcgcccgccaggcgcccagtcctctgccatcgcccacgcctccctggtgccagggaacaggtatcagcgcgcctccccagcggctgggagagacgctgaatgaagaagagggaaggacggttagtcagcagtcttatagctggatcagctaccaagagaagttctaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtg

SEQ ID NO: 304922 - DNA, 1138 bp, Homo sapiens
tgagtccaaggtttctcgtgcggcaactgccagagctgcttggagagctaagctggaagggtgcttatccctgcgtagaaacgcctgccaatgctttctcatttggacccagactccagatcgggagcagtcttatagctggatcagctaccaagagaagttctaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtg

SEQ ID NO: 304923 - DNA, 704 bp, Homo sapiens
cgcgcgggcagggggcggggactgtcgcgtggagctgccgggcgagcaccgttagggcagcctggcgcgcggcgcccgccaggcgcccagtcctctgccatcgcccacgcctccctggtgccagggaacaggtatcagcgcgcctccccagcggctgggagagacgctgaatgaagaagagggaaggacggttagtcaggtgagccgcggcggggtgggcggccggggcggccacgccctgccgagggagaagagccggtcgtgtgcggagggacagggtgaagggatcccacttcggggaggatgggcttatcccggcgggcgcgccaggtgggatctctagcgcctcaggggcccgcgcggcaacagccggcaccctcgggcccgcggacaaagggttaacgcgttggcagtgactgcgggccccggatgtgagagccttggcttgacgccctggctgcgctgcaggtgcgccgggccgaacggagccggcagcctggcggcgacctgaccgcccgaggctccccttcacctgcagcggctgctcggctccctctgggaacgccgccttttctaacttaagggcaacaggtggtgccggtggaccgagagagagctcagctccgccgcgctgggagcggcagttaccctcaccaattagggagcgggggcgggagttgcatggcttccctgatgcgggtgac

SEQ ID NO: 304924 - DNA, 3273 bp, Homo sapiens
cgcgcgggcagggggcggggactgtcgcgtggagctgccgggcgagcaccgttagggcagcctggcgcgcggcgcccgccaggcgcccagtcctctgccatcgcccacgcctccctggtgccagggaacaggtatcagcgcgcctccccagcggctgggagagacgctgaatgaagaagagggaaggacggttagtcagcagtcttatagctggatcagctaccaagagaagttctaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtgtctgcctagtgttttgtgcttacatctttcggggggaagcctttgcaagaaaattgcatacaaggctttgtaacgatcaagtgctaatcgatggaaatgttaaggtagattaacatatatgcagttatattgatcacattggtccaaccagtccttttttgaagtaagggacaaggagtaagtattttcttttttaagtttctgccaaatgatttttgacgctttctggaatcaagtaatttaatagtatagcttaattctagacaatgtttaagttggtctacctttattaaaaataagatatttggggtatattcaagtgcatggattagttttcctgacaaagcatgttttggtgtgtagtcttactttttagaaatagctatgcatcgttctacacaggtttaaaacaacttttttggggatttagggctattataggaatagtttgttgtcagaagcactttcacttgaagaacctaaaatgattgactcattcatagtaaatatgggcatgtaaactaataaatatgcactggatacatatatggatttatgaagaaggcgatttagtcaagaggatgtaattaaaatatgtggtctctaaaatattccagttacaagatatttgttttattaatatttgctggctaaaaacaaatgtggtttttatatatttttgtagtgtgttgagaagagcaaaagctttataaatatacctgatgcgctgtagaatgaaaatgtaaaagataacctgtatgtgttccgagctttaattttttgtttacaaattgaacagtgttacatgggctgtccagtcctgattatagagaggaagaaatggtaacagtatggcagataagaattacaattatagaaaatgaggggaaaataacaaacctgttttatgaaaattcactggtgctgtttacattggaataaaaagctctataaggagaaaaggcctttatctaattcttatctacagacacttacttccagtgaccatattttactaaatcagcttattttttatgtctaaagcaacagctgttctgaaaaatcaccaaaagaaatgcactttgctagcaggatttgttttggctttgggttttgtttttttgttttttttttttttcagtggcataacagtttttggaaccttgattctgtgtgtcacacaaaatgaatgaagtagcttgatgtggagccttcatatgttaaatattcctgcactagtgatggtcacttagaatgtttatagaaatgtggataataactaccaataaactacttgaggcactaggagaacagtatttgactttgaattttaatgtatttccacttttgctgaagcttttaatcagatgtgtaaaaacaattgaccagctaggctatttagtcccatagtagttcagatctgcttagatgtgacaggcattgaaggctgtttttttttttttctcccttcactgatactgaaatcatggtatctgctgcaaacatgagtagatccatgatggattaataaagcttgctgaaaaaaaaaatctgtgtatcaattagatttaccagtttgcctgtactttctgtctacctactatgtaaaatagtgctgtttttaagtatttcaaaagcttgtgtgttgaccctttgtagcctaagtacgtaaacaaattaatgttatctaagtttttcatatttcatggacaacaaaagagaaaatggtatgaacactgtacaaactttgatttataaaagacaatttcagctataaaacccatcctaagattttctagcttgctaagttcaagttccctaccgcctattctagttattaacactgtagtataatgagtctttaaattctgaagagtttagactatgctttcatatctagtttcttcttatggcgcaccttttctagtgcatagttctaaaatattttcttgtatttgaagttacttggtttaatacaaaatattaaggactgctcaactgaatccaagttaatatcaaagaacaaagtgtaagaaaaataaaaccttttgatagttaaagat

SEQ ID NO: 304925 - DNA, 903 bp, Homo sapiens
  misc_feature (888)..(888): n is a, c, g, or t
cgcgcgggcagggggcggggactgtcgcgtggagctgccgggcgagcaccgttagggcagcctggcgcgcggcgcccgccaggcgcccagtcctctgccatcgcccacgcctccctggtgccagggaacaggtatcagcgcgcctccccagcggctgggagagacgctgaatgaagaagagggaaggacggttagtcagcagtcttatagctggatcagctaccaagagaagttctaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagagtgattttgantaggagtgtctacgg

SEQ ID NO: 304926 - DNA, 799 bp, Homo sapiens
gccccggaagccggttctttggccctgtgacacgtagcaacggggctggttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggtaagattttcatttcaaccttcagggtgcaattaaagaacagcctttaaattttaaatgttctaccaaaagccattttgaaactccgctttacacctcaagtctttgatgtgtttggaatagtactgagttgcttgtatttatacctattcattagttctccatctatagtaagtgtagcatgttttaaaaatcatttctttttctaagaaatgattaaattattagg

SEQ ID NO: 304927 - DNA, 3168 bp, Homo sapiens
gccccggaagccggttctttggccctgtgacacgtagcaacggggctggttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcattagccatggaaggacagcaacttttagtagcatatccttgcgctttgttatatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggcgtggtagctcacgcctgtaatcccagcactttgggaggccgaggcgggcggatcacaagggcaggagatcgagaccatcctggttaacacggtgaaaccccgactctactaaaactacaaaaaaaattagctgggcgtggtggcgggcgcctgtagtcccagctactcaggaggctgaggcaggagaaaagtgtgaacccaggaggcggagcttgcagtgagccgagatcacaccactgcactccatccagcctgggtgacagggtgagactctgtctcaaaaaaaaaaaaaaaaaggagacacaagacttactgcaaaaatatttttccaaggatttaggaaagaaaaattgccttgtattctcaagtcaggtaactcaaagcaaaaaagtgatccaaatgtagagtatgagtttgcactccaaaaatttgacattactgtaaattatctcatggaatttttgctaaaattcagagatacgggaagttcacaatctaccttattgtagacatgaaatgcgaacacttacttacatattaatgttaactcaaccttagggacctggaatggttgcattaatgctataatcgttggatcgccacatttcccaaaaataataaaaaaatcactaaccttttttaaggaaaatatttaaagttttacaaaattcaatattgcaattatcaatgtaaagtacatttgaatgcttattaaaactttcccaattaattttaactgtgttattgaatttacttttactaaactactgttctctttgtctcttttttaactaggctctgattttgacccctaatttaagctttaagaatagaaatcagctaatatagaatcagacaaaaaggggattaaatgagcagtttgagttacattattttattgtattaaatttatttgatttatattgtcatgttctcttgccagagagaatctgtaggaaaatactgtatcttgtatactgatcattggctttttctagaaaaactgtctctgattctggacaaagctcagttatagttacgagaaagatatggtacagggaggaaaatactgccttttttttttttttttaaagagattttcagactaaatagaaatgtcaaaatgatgtatcaatggttcttttttagaacaagttttcaaagcataaaaagaggttgagagaaataacatatttattgattcacataagtatgtttttcttcattaatcgtctggagaaacccacttgtcattaatttgttttgggctaggttttcaaacttaccaaattgctttaaaaaagcaatttggaaggtaatttgataggctttccaacttaaccaaattttttattgtaattcttggatagtatttttgtctttttcaattcatttgtctttttcagtatagtttttgttaaggcaaatgtcttcccttaatatccaaatattgctaataaacggtagaagatgctttggaaattaaaattatctcgctgttggttagacttaacactgttaatcttcagccaaatatcacatatggatcaaattattttcttttttgttgtttaccctatcctcaacaacatttttagtttaaattattgtagagattttttttgtggtggttattttttattttgctccaaaataataaggtgcaaagctattttatgcttaactgttgctctgtcaaaacagctatgcagtggagttgcatttgatgttctagagtttgattacatgcagagttgtatatagccaaaacttctcttatcaaactctgttatgtaggcatatttatatatacattaaagactgttgtactgtgtctcaaaaagtactatgtggcg

SEQ ID NO: 304928 - DNA, 2041 bp, Homo sapiens
gccccggaagccggttctttggccctgtgacacgtagcaacggggctggttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcattagccatggaaggacagcaacttttagtagcatatccttgcgctttgttatatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggcgtggtagctcacgcctgtaatcccagcactttgggaggccgaggcgggcggatcacaagggcaggagatcgagaccatcctggttaacacggtgaaaccccgactctactaaaactacaaaaaaaattagctgggcgtggtggcgggcgcctgtagtcccagctactcaggaggctgaggcaggagaaaagtgtgaacccaggaggcggagcttgcagtgagccgagatcacaccactgcactccatccagcctgggtgacagggtgagactctgtctcaaaaaaaaaaaaaaaaaggagacacaagacttactgcaaaaatatttttccaaggatttaggaaagaaaaattgccttgtattctcaagtcaggtaactcaaagcaaaaaagtgatccaaatgtagagtatgagtttgcactccaaaaatttgacattactgtaaattatctcatggaatttttgctaaaattcagagatacgggaagttcacaatctaccttattgtagacatgaaatgcgaacacttacttacatattaatgttaactcaaccttagggacctggaatggttgcattaatgctataatcgttggatcgccacatttcccaaaaataataaaaaaatcactaaccttttttaaggaaaatatttaaagttttacaaaattcaatattgcaattatcaatgtaaagtacatttgaatgcttattaaaactttcccaatta

SEQ ID NO: 304929 - DNA, 3113 bp, Homo sapiens
gccccggaagccggttctttggccctgtgacacgtagcaacggggctggttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcattagccatggaaggacagcaacttttagtagcatatccttgcgctttgttatatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggcgtggtagctcacgcctgtaatcccagcactttgggaggccgaggcgggcggatcacaagggcaggagatcgagaccatcctggttaacacggtgaaaccccgactctactaaaactacaaaaaaaattagctgggcgtggtggcgggcgcctgtagtcccagctactcaggaggctgaggcaggagaaaagtgtgaacccaggaggcggagcttgcagtgagccgagatcacaccactgcactccatccagcctgggtgacagggtgagactctgtctcaaaaaaaaaaaaaaaaaggagacacaagacttactgcaaaaatatttttccaaggatttaggaaagaaaaattgccttgtattctcaagtcaggtaactcaaagcaaaaaagtgatccaaatgtagagtatgagtttgcactccaaaaatttgacattactgtaaattatctcatggaatttttgctaaaattcagagatacgggaagttcacaatctaccttattgtagacatgaaatgcgaacacttacttacatattaatgttaactcaaccttagggacctggaatggttgcattaatgctataatcgttggatcgccacatttcccaaaaataataaaaaaatcactaaccttttttaaggaaaatatttaaagttttacaaaattcaatattgcaattatcaatgtaaagtacatttgaatgcttattaaaactttcccaattaattttaactgtgttattgaatttacttttactaaactactgttctctttgtctcttttttaactaggctctgattttgacccctaatttaagctttaagaatagaaatcagctaatatagaatcagacaaaaaggggattaaatgagcagtttgagttacattattttattgtattaaatttatttgatttatattgtcatgttctcttgccagagagaatctgtaggaaaatactgtatcttgtatactgatcattggctttttctagaaaaactgtctctgattctggacaaagctcagttatagttacgagaaagatatggtacagggaggaaaatactgccttttttttttttttttaaagagattttcagactaaatagaaatgtcaaaatgatgtatcaatggttcttttttagaacaagttttcaaagcataaaaagaggttgagagaaataacatatttattgattcacataagtatgtttttcttcattaatcgtctggagaaacccacttgtcattaatttgttttgggctaggttttcaaacttaccaaattgctttaaaaaagcaatttggaaggtaatttgataggctttccaacttaaccaaattttttattgtaattcttggatagtatttttgtctttttcaattcatttgtctttttcagtatagtttttgttaaggcaaatgtcttcccttaatatccaaatattgctaataaacggtagaagatgctttggaaattaaaattatctcgctgttggttagacttaacactgttaatcttcagccaaatatcacatatggatcaaattattttcttttttgttgtttaccctatcctcaacaacatttttagtttaaattattgtagagattttttttgtggtggttattttttattttgctccaaaataataaggtgcaaagctattttatgcttaactgttgctctgtcaaaacagctatgcagtggagttgcatttgatgttctagagtttgattacatgcagagttgtatatagccaaaacttctcttatcaaactctgttatgtaggcatatttatatatacattaaagactgttgtactgtgtctcaaaaagtactatgtggcg

SEQ ID NO: 304930 - DNA, 2361 bp, Homo sapiens
agtaagctcttgttttgaaaaacagtggggtggggccaaaaaagcattacaatggagctgggatggatgaggctttcttttatttgagatgtcacttgtgtcacgtttcctgaaacagcacgttggaaaacagaagctattttctatcccgtgggttgcgctggaagagctgagaggccaggctgtggatccttgccacgaacaacaagagagggcaagtccagccgcctgctaggggactagcaggaagcggcacgcctgccagagctcatcacttcaactctggctttcactgcgctcattccctgaatggcagtaaccagggggcgggggtggcatgggaaatgaaagaaagagatatgggaaactaaatctgccgggggaaagagagttaccggagttttagcaaaacagctagcagatgcaaacggggaggcagagggaggagggaaggctgggcttcagcaacctgccacggggatttaaacaaaggaggtttgagagaggcgggatctggctgtaatatcggcacagggacagagacagcagctggactctcgggatgaaacggaatcgattcccagcgtctccaacagggcaggagtgagtggagtatgttgcaaaataagaactcagagaaacgagtgagtttggaaaaaagacttacagattttgacggtctcttgacatttcacccttctttgaggcatgcctttatcaatgcgttacctcttcataatttctgtctctagtgtaattatttttatcgtcttctctgtgttcaattttgggggagatccaagcttccaaaggctaaatatctcagaccctttgaggctgactcaagtttgcacatcttttatcaatggaaaaacacgtttcctgtggaaaaacaaactaatgatccatgagaagtcttcttgcaaggaatacttgacccagagccactacatcacagcccctttatctaaggaagaagctgactttcccttggcatatataatggtcatccatcatcactttgacacctttgcaaggctcttcagggctatttacatgccccaaaatatctactgtgttcatgtggatgaaaaagcaacaactgaatttaaagatgcggtagagcaactattaagctgcttcccaaacgcttttctggcttccaagatggaacccgttgtctatggagggatctccaggctccaggctgacctgaactgcatcagagatctttctgccttcgaggtctcatggaagtacgttatcaacacctgtgggcaagacttccccctgaaaaccaacaaggaaatagttcagtatctgaaaggatttaaaggtaaaaatatcaccccaggggtgctgcccccagctcatgcaattggacggactaaatatgtccaccaagagcacctgggcaaagagctttcctatgtgataagaacaacagcgttgaaaccgcctcccccccataatctcacaatttactttggctctgcctatgtggctctatcaagagagtttgccaactttgttctgcatgacccacgggctgttgatttgctccagtggtccaaggacactttcagtcctgatgagcatttctgggtgacactcaataggattccaggtgttcctggctctatgccaaatgcatcctggactggaaacctcagagctataaagtggagtgacatggaagacagacacggaggctgccacggccactatgtacatggtatttgtatctatggaaacggagacttaaagtggctggttaattcaccaagcctgtttgctaacaagtttgagcttaatacctacccccttactgtggaatgcctagaactgaggcatcgcgaaagaaccctcaatcagagtgaaactgcgatacaacccagctggtatttttgagctattcatgagctactcatgactgaagggaaactgcagctgggaagaggagcctgtttttgtgagagacttttgccttcgtaatgttaaccgtttcaggaccacgtttatagcttcaggacctggctacgtaattatacttaaaatatccactggacactgtgaaatacactaacaggatggctgggtagagcaatctgggcactttggccaattttagtcttgctgtttcttgatgctcacctctatattagtttattgttaggatcaatgataaatttaaatgacctcagatctttgcaccagatactcatcatatacaaatgttttagtaaaaaagagaattgtagataatactgtctaggaaaataagaattaggtttctttgaagaaggaatcttttataacaccttaacagtcaccactgtgctcaaccagacagatagtgaa

SEQ ID NO: 304931 - DNA, 1826 bp, Homo sapiens
agtaagctcttgttttgaaaaacagtggggtggggccaaaaaagcattacaatggagctgggatggatgaggctttcttttatttgagatgtcacttgtgtcacgtttcctgaaacagcacgttggaaaacagaagctattttctatcccgtgggttgcgctggaagagctgagaggccaggctgtggatccttgccacgaacaacaagagagggcaagtccagccgcctgctaggggactagcaggaagcggcacgcctgccagagctcatcacttcaactctggctttcactgcgctcattccctgaatggcagtaaccagggggcgggggtggcatgggaaatgaaagaaagagatatgggaaactaaatctgccgggggaaagagagttaccggagttttagcaaaacagctagcagatgcaaacggggaggcagagggaggagggaaggctgggcttcagcaacctgccacggggatttaaacaaaggaggtttgagagaggcgggatctggctgtaatatcggcacagggacagagacagcagctggactctcgggatgaaacggaatcgattcccagcgtctccaacagggcaggagtgagtggagtatgttgcaaaataagaactcagagaaacgagtgagtttggaaaaaagacttacagattttgacggtctcttgacatttcacccttctttgaggcatgcctttatcaatgcgttacctcttcataatttctgtctctagtgtaattatttttatcgtcttctctgtgttcaattttgggggagatccaagcttccaaaggctaaatatctcagaccctttgaggctgactcaagtttgcacatcttttatcaatggaaaaacacgtttcctgtggaaaaacaaactaatgatccatgagaagtcttcttgcaaggaatacttgacccagagccactacatcacagcccctttatctaaggaagaagctgactttcccttggcatatataatggtcatccatcatcactttgacacctttgcaaggctcttcagggctatttacatgccccaaaatatctactgtgttcatgtggatgaaaaagcaacaactgaatttaaagatgcggtagagcaactattaagctgcttcccaaacgcttttctggcttccaagatggaacccgttgtctatggagggatctccaggctccaggctgacctgaactgcatcagagatctttctgccttcgaggtctcatggaagtacgttatcaacacctgtgggcaagacttccccctgaaaaccaacaaggaaatagttcagtatctgaaaggatttaaaggtaaaaatatcaccccaggggtgctgcccccagctcatgcaattggacggactaaatatgtccaccaagagcacctgggcaaagagctttcctatgtgataagaacaacagcgttgaaaccgcctcccccccataatctcacaatttactttggctctgcctatgtggctctatcaagagagtttgccaactttgttctgcatgacccacgggctgttgatttgctccagtggtccaaggacactttcagtcctgatgagcatttctgggtgacactcaataggattccaggtgtggatctcactctgtggcccaggctggagtgcaggggcaacatcatggctcactgaaccctggacctcctgggctccagcaatcctcccacttcagtctcctgagtagctgggactacaggtgcacaccaccatactgggctaatttttaaaaaaaattttgtgcagacagggtctcgctatgttgcccaggctgg

SEQ ID NO: 304932 - DNA, 2644 bp, Homo sapiens
aagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctccctttctgcggcaggagttcatccggatccggcctaatcgtgaaggagaccgggaagccatcgtggcagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaaaaaa

SEQ ID NO: 304933 - DNA, 2592 bp, Homo sapiens
  misc_feature (30)..(30): n is a, c, g, or t
  misc_feature (35)..(37): n is a, c, g, or t
cgcaagaacttacggctaggtacgaggccngggtnnnggtctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctccctttctgcggcaggagttcatccggatccggcctaatcgtgaaggagaccgggaagccatcgtggcagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaaaaaa

SEQ ID NO: 304934 - DNA, 2737 bp, Homo sapiens
aagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacagcccgcctgtcgacacagcctggccacacgcccccactttgtggcttctgcatttgccatttcctcagcctggagccatctcctgccccttcaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctccctttctgcggcaggagttcatccggatccggcctaatcgtgaaggagaccgggaagccatcgtggcagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaaaaaa

SEQ ID NO: 304935 - DNA, 2677 bp, Homo sapiens
aagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgagagagctgaggaaacctggctttgtgcttggcaggtgaaagatctggcttctgtctccttgaagaatcctgtccggatatttgtgaacagcaacacagatgtggctccctttctgcggcaggagttcatccggatccggcctaatcgtgaaggagaccgggaagccatcgtggcagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaaaaaa

SEQ ID NO: 304936 - DNA, 2756 bp, Homo sapiens
aagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctccctttctgcggcaggagttcatccggatccggcctaatcgtgaaggagaccgggaagccatcgtggcagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccaggtgatactggctgttttggaggggcataggttttgggattagagataaaaacctttcatggaaaagaagcttctccatcctcattctggtcttaactctgattttcttacagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaaaaaa

SEQ ID NO: 304937 - DNA, 2739 bp, Homo sapiens
aagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctccctttctgcggcaggagttcatccggatccggcctaatcgtgaaggagaccgggaagccatcgtggcagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagtgagtggcctcccttttggagtttgggcccactcggtggggtgggtcagagtggcctggtgtgttccacactcacacctccccactccccctaggcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaaaaaa

SEQ ID NO: 304938 - DNA, 2408 bp, Homo sapiens
aagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctccctttctgcggcaggagttcatccggatccggcctaatcgtgaaggagaccgggaagccatcgtggcaggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaaaaaa

SEQ ID NO: 304939 - DNA, 2814 bp, Homo sapiens
aagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcaggcaagttacttcaccatgctgccacaaagtgtcctcatctgtgaaacaaggttgacgatggtcacccctcagaggctgaagtgtggcattggcacttaggacagtgtccagcaggatgcaagtgctttgtaagtctgagccgtggtcatcagctaagtttttctccatagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctccctttctgcggcaggagttcatccggatccggcctaatcgtgaaggagaccgggaagccatcgtggcagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaaaaaa

SEQ ID NO: 304940 - DNA, 2050 bp, Homo sapiens
aagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgaggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaaaaaa

SEQ ID NO: 304941 - DNA, 1559 bp, Homo sapiens
aagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctccctttctgcggcaggagttcatccggatccggcctaatcgtgaaggagaccgggaagccatcgtggcagctttgttgacgaggaccttcactgaccatgtgatgctgttcacgcaaaccaagaagcaggcccacccgatccagaaggcgtgcatacctgtgggtctattggggaaggacatctgtgcctgtgcagccactgggacagttcaactgcctgttttgggcgtctgatttataccccctgatatctt

SEQ ID NO: 304942 - DNA, 2011 bp, Homo sapiens
  misc_feature (9)..(9): n is a, c, g, or t
ttcacgggnctatcggtcggacccagcgccgctcgcgtttcccgcccgcgtctgcaagggccattccaggcccatggggcgagccaagccatgccccaccccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctccctttctgcggcaggagttcatccggatccggcctaatcgtgaaggagaccgggaagccatcgtggcagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaaaaaa

SEQ ID NO: 304943 - DNA, 2075 bp, Homo sapiens
gtagagacagagtctggccacgttgcccaggctggcctcaaattcctgggctcaagcaatcctcccacctcaatctcccagagtgccgggttacaggtgtgagccaccatgcctggcctacccttatttgtaaatcctttttattttctcccattgagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctccctttctgcggcaggagttcatccggatccggcctaatcgtgaaggagaccgggaagccatcgtggcagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaaaaaa

SEQ ID NO: 304944 - DNA, 1207 bp, Homo sapiens
  misc_feature (810)..(810): n is a, c, g, or t
  misc_feature (824)..(824): n is a, c, g, or t
  misc_feature (839)..(839): n is a, c, g, or t
  misc_feature (856)..(856): n is a, c, g, or t
aagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacagtnaaactgcgctttgnctgctgtttggacgnctgttataaccggcggnccatcaccgctgttctgtgctatgcccaccgaaagttggcttcaggtgctctggtccaagacagtggggccaggtctgggacatacccactagcggggtgtgggcggaataagagtgaaaccccaggagaagctctcagggagagcgctaggatctacagacacaccacaaggcggggacaaagaacccaaaagagggcagccatacacaaaggagcaaccaagggcgacaccggaaggcggacaatcggtgcgcagcacccatagcgaaaaagcacgaagagtgatcacaccagagaatatctgtacagacacgcaggaacgacgcaacaaacacagagtaaacgacacg

SEQ ID NO: 304945 - DNA, 1606 bp, Homo sapiens
aagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagagcgcatgcacatcctcctggggctcatggggctgcaggtgggtgagctccatggcaacttgtcacagacgcagcggctggaggccctccggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaaaaaa

SEQ ID NO: 304946 - DNA, 1631 bp, Homo sapiens
tgagacaattgcctatgctgttagcagatacagaactacgtttgctctgtatgatgggttgttgaagggtgggtgtaaatatcccatgtgctcacatttagaatctatccctatttttttttttttttgagacggagtctcgctctgtcgcccaggctggagtgcagtggcgcaatcttggcttactgcaagctccgcctcccaggttcacgccattctcctgcctcagcctcccaagtagctgggactacaggcgcccgccaccatgcctggctaattttttgtatttttagtagagacggggtttcaccgtgttagcgaggatggtctcgatctcctgacctcgtgatctgcccacctcggcctcccaaagtgctgggattacaggcgtgagccaccgtgcccagcctctatccccattttaatgccctgttctgtcctctgctggctcaggctcttgtggagcattattaggggagggtgtctggatgaacagctgtttgtgactgtttctaggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaaaaaa

SEQ ID NO: 304947 - DNA, 1980 bp, Homo sapiens
gtagagacagagtctggccacgttgcccaggctggcctcaaattcctgggctcaagcaatcctcccacctcaatctcccagagtgccgggttacaggtgtgagccaccatgcctggcctacccttatttgtaaatcctttttattttctcccattgagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctccctttctgcggcaggagttcatccggatccggcctaatcgtgaaggagaccgggaagccatcgtggcagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaaaaaa

SEQ ID NO: 304948 - DNA, 1668 bp, Homo sapiens
aagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgtggcttcaaagcaggccccagcccggatccaagaaagggccgttgcatacctggtgggggtcctattgggggcaacggacattcttgtgcccttgttggcagcacacctggggacacaggttaaaactggccgacatttgtggcctggctgtgtttggcagcgtcatgaattctactaaaaccccggccaaggttccacgttcacccgctgttgcatggatgcatagtggccaacccgcgagaaggctggggcatttccaggttgtcacttcctggtccaccaagaacaagcgtgggacacaaggttctggcaagcatcaaccaccttgaccctgggttggttgggacgggaatagtggcatgtgtgtaaaaggatcccccacgagaaaagccacagcctctgacacgcggcacaggcggcccttgacacaatgttacgttacattgggaccaaccccccagagcgcccgcgggtacacattggaaatgtcgagcctccacatagaaaggggcgacctttggcctatttccaccaccgtgacacacagcggccacttacagaggcgttgcccaacaatcacttgggaccaaaaggcggctgtacacgagagaacgccgcgggacgagacatactcatggaacggcgagcacccacaatcggaacggggggcaaaacaaccgcccgcaggaggggttgtcccaccacggacagccgtacaagacaacgagcggactcagctaccgaggccacagacaagagcgcgcagccgagaaggcaaaaaaaatagcggacacctgcagacccaccgaagacaaaacaaagctggcgggggaactatggtgagcaacaagacgaccagacacgagtagcggaccccgagcgcgagagagaaaggataatagagcgaaaggcgagctatgagtgggagtgaagaaccggggacgcccgcg

SEQ ID NO: 304949 - DNA, 1013 bp, Homo sapiens
gtagagacagagtctggccacgttgcccaggctggcctcaaattcctgggctcaagcaatcctcccacctcaatctcccagagtgccgggttacaggtgtgagccaccatgcctggcctacccttatttgtaaatcctttttattttctcccattgagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaaaaaa

SEQ ID NO: 304950 - DNA, 1171 bp, Homo sapiens
gatggggtttcaccatgtttgccaggatggtctcgatctcttgacctcctgatccacccgcctcagcctcccaaagtgctgggattacaggcttgagccaccgtgcccggcgagcccttggtattctaatggaagctatgagtcttctgcctccttccccatttccagtttttgcacacctatagctttatactatgtaaattcaagggtacctgtctgttctccaccccccacccctctcagagccacctgaggatcccaaggtgagaacaggagaggggtgttcagttagcactgttcctgccttggaggtgaaatagtacattgttgggttcagaaatggagctttccttcaggggagtgataactctttcatctcaagttccatcctgcagaaccccagagaatcctggcttgctcttaggaatatgttgtcccacaccattttccccagcccaaggttggggcaggggcagactaagcttcccaagtagtggtatatacctaagaagggcctcttccaaccttgttttaaaattgggccctgacttccagaaacacgttatcaggtggaaacacataaaggcttagaacttagggcctgaaaatgatgcatcccagagatgctactgcttcatgtaggagctggggagggtgggggtgagacaacacccatttgttcaacagtttgctcatttcagcatgtcatcttctctcacagcccttcctttgaagaaaggaaacagttgggcttgccccaccagagacgaggaggaaactttaaatctaaatccaggtgatactggctgttttggaggggcataggttttgggattagagataaaaacctttcatggaaaagaagcttctccatcctcattctggtcttaactctgattttcttacagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaaaaaa

SEQ ID NO: 304951 - DNA, 363 bp, Homo sapiens
  misc_feature (30)..(30): n is a, c, g, or t
  misc_feature (35)..(37): n is a, c, g, or t
cgcaagaacttacggctaggtacgaggccngggtnnnggtctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttccgttgaagccgtcgggatcctctagatacaccc

SEQ ID NO: 304952 - DNA, 188 bp, Homo sapiens
gctgttctgaattcttagcgtgtcctcctgttttcacattccacagcccgcctgtcgacacagcctggccacacgcccccactttgtggcttctgcatttgccatttcctcagcctggagccatctcctgccccttcaggtttctgttccagttgttatcttgttagtggggcctttgctggctgccc

SEQ ID NO: 304953 - DNA, 409 bp, Homo sapiens
tgaagaatcctgtccggatatttgtgaacagcaacacagatgtggctccctttctgcggcaggagttcatccggatccggcctaatcgtgaaggagaccgggaagccatcgtggcagggtggcagcacagggcaagcctgggcagggtgggctggtcagcttccttgagctcgtagtatccatgctgaagtgcttggtttcccctgcgcctctgccgtccagtcttccccagcgcagaggctgcactgcactaatgatgatccgctgcctctcttctccacgggtccttcctccctttgctttatcgcctcaccaatcctctttgtgtcctgttcaactcccaaccacttggcatcagctgctgttgtacccgtcagtccagaccactgttctctgtcgcctggatcgt

SEQ ID NO: 304954 - DNA, 255 bp, Homo sapiens
atttgtaaatcctttttattttctcccattgagatgtcatcctcaaattccgggacaagattgagaaaatggagaaagatgtgtatgcagttctgcagctagaggcggaggaaaaagagatgcagcagtcagaagcccaggtgaggctgcgaggcgggatcttgttcacaaggctgctcagtaagcaagctgctgcatccctgctggtgctgcccttctgaaatgtttctcccatcagagccccaggcatttgca

SEQ ID NO: 304955 - DNA, 986 bp, Homo sapiens
attcttgggtatatttgtatataaccagataactagagtgcatatgtatgtgtgtgtgcacatgcgtgcatgtgtgtatgtatttatctcagatcaagttagttcaaagtaagggcagaaatgctgtttcctttttcaacaggtaacatatttacagaatccaagaggttttagtttcgagagagcatttctaaagaaacagcactatcatacactctgtccacccaaaattcactaaaagactaacatacaaaaggttgagaatacaaagtttacactgaaatgcactcaaccatgattgtgaagtttttactacctttaactcccatcaccctagtaaacagataacgaagggaagaaaaaaaaccacacctctccaagaaatgttatgcactgatcaaatgttgaaagagaggaggaaaagggagggaaggctagcacaatacctactagcaggaggctagtattagtacctacagcacattttcaatctcttgtatctgtgttctttaaatcctcaaaacagtatcaattcttatagttgggtttttcttagaacttcaacaattatagtatcataccattcagcacatgaagataagaaatcactacgtctgaaggttaaaagtaaactttagtctaacattgtctcttatttagttcatctccaacaaactatgtgccaagcattgtgctacatggtagaatataacagtaaatacgacagaacaccatgacaggaaagtttaggttctagtggagaagacagacaaattaagcaactgtaatctggtatagtaagtaggaggatacacagggatacaaaaaaatacctgtctcagtcttagaattttagcatacatttcctgaaagaactgatggctaaactgagacctaaaagatgaatggcaactgacttggaaaaagtgagggactgagaaggaaagtgagaaaaatataacaggcagtgggaaaaagcacaggca

SEQ ID NO: 304956 - DNA, 621 bp, Homo sapiens
aaaagcttctgaaaccaaacaagggactgtaaaaatgcagcacaagcagcagctaagaaggatgaaaagaaggaagattccaagaaaacaaaaaaacctgcagaagtagaacaacccaagggaaaaaaacaggaaaagaaagaaaaacatggggaaccagcaaagtcaccaaagaaagaacactcagttccaagtgacaaacaagtaaaagcaaaaactgaacgagccaaagaggagattggtgcggtttcaagtaaaaaagctgtacctggaaagaaggaagagaaaacaaccaagacagtggagcaagaaattagaaaagaaaaatctgggaagacttcttcaattctgaaagataaagaacctattaaagggaaagaagagaaagttccagcttccctaaaggaaaaagaacctgaaactaaaaaagatgaaaagatgtccaaagcaggcaaagaagtcaagcctaaactccacaatacaaggaaacaacaggaagagaagccagagcccccaaattaaaaaagaagcaaaaccagctatatctgaaaaagtgcaaatacacaaacaagacatagtgaaaccagaaagactgtttctcatggtaaaccaggaagaaag

SEQ ID NO: 304957 - DNA, 347 bp, Homo sapiens
  misc_feature (71)..(71): n is a, c, g, or t
tgtaaacaatggttccctacataattgtaatagtgttttacgttgtcccaacaccaggcaaaacccaagtnctattgcaagctttgtaaatctttatcactgtccttgcatgtttttctgtgccagggagaatgtgagacagcaatctgggttggtctttcttttgtgtaactgaactttgaatatcagttccgaacagggaaactccacaaactgtttaattacatcaggggacatgctgaagattgctgggaataagacaatgatccagggtaactggtagacatattcctatttgatttgtggttttaacaccaccttactgattataatttgaaaaataaaga

SEQ ID NO: 304958 - DNA, 677 bp, Homo sapiens
aaaagcttctgaaaccaaacaagggactgtaaaaatgcagcacaagcagcagctaagaaggatgaaaagaaggaagattccaagaaaacaaaaaaacctgcagaagtagaacaacccaagggaaaaaaacaggaaaagaaagaaaaacatggggaaccagcaaagtcaccaaagaaagaacactcagttccaagtgacaaacaagtaaaagcaaaaactgaacgagccaaagaggagattggtgcggtttcaagtaaaaaagctgtacctggaaagaaggaagagaaaacaaccaagacagtggagcaaggtaaaaaaaaatgaaggaggttgacattatcttctttagaaagacaacaacatgcggaggaaagcactggattcagacaggcggaagacaataacctttaagtctattactctttatcactgtccttgcatgtttttctgtgccagggagaatgtgagacagcaatctgggttggtctttcttttgtgtaactgaactttgaatatcagttccgaacagggaaactccacaaactgtttaattacatcaggggacatgctgaagattgctgggaataagacaatgatccagggtaactggtagacatattcctatttgatttgtggttttaacaccaccttactgattataatttgaaaaataaaga

SEQ ID NO: 304959 - DNA, 406 bp, Homo sapiens
agggatggatgatgacaagcaaagaatgagatgccacagaaatctgttgcattccagccagcacagtggccctagaatgaattttctgtgcagtgggccagacttcttgatacagcccaccatgtagaatggaaacatcaagtacagctgacctggtcccccctcccttgctcatctgggccgggcatcccttagtccgcaacagtgccttttcctcacgtgtcctgctctcagagttcaaggcaacatggcaggctgagcagagctgtcactgctggtttggccccgtttctccacagagagacaagaaggaccaaaggaagctctgtcctgttctattcctctatgttgtccattgaatacgtggtgacccagccctgagcaccaaggtccttccctctctatt

SEQ ID NO: 304960 - DNA, 740 bp, Homo sapiens
accacgcgtcgccacgcgtcgccacgcgtgcgcaagaatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304961 - DNA, 329 bp, Homo sapiens
atatcgtcgacccacgccgtcggtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304962 - DNA, 982 bp, Homo sapiens
tccactctggttgaggcaagagaggtgggggatgctaggttccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacacggtaccggagtaccagggaccggactcagcgacgggacatcgaagggacatcttgttggtcgaatggggtccccgggccaatggaacgggaaccgggcagctgacggtaatcggcggagaaccgggggccgggggggcagacaggcacaggaggaggccggaacacagtctaacggaaagggggcctgggcccacactcgcggaaattgggccggggaagataacgtaaaccacaagaagacacaagacaggcaacaggagaaatagaccgatcagaaaaaagagcaccaa

SEQ ID NO: 304963 - DNA, 584 bp, Homo sapiens
ctgagcaagaacatcagagggcaggctctgaggagaggagaaggaagagccagggtggagggtgagtgtgtgtcttccccaggcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304964 - DNA, 3300 bp, Homo sapiens
  misc_feature (32)..(33): n is a, c, g, or t
ctgtcggccggaagtattggattgtcgacccnncgtcgcgtctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304965 - DNA, 7003 bp, Homo sapiens
gagttcctggctgggcagcactcaaggcccaccccctggcatcaggctgcacattcagcatcgacagccctggccagtaggccttctgggctcccagcaacgcctgcattttccacattggtttgcatgactggtaatgtcccttcacagggccaccctcaccccacccccaccccaggtctagagatttcctgaattgctttgcttaacccatgattctgctgtctaacctccatccttccagctgcaaagtcagctcctcctctgtgcagggagtgggagcaccacaggagccaatgcccaatcatagctgcctccagggaggtagctacggtcctttgcaccccattctgcctccagaatatgagttttccattttttttattagaaagggtgtctcttttcaggagcaaagcccccattctcccttcatccacttcttacagtctaattgactccctcctccttcttctttgaacaacgagaagactctccagttgtccaacttccacccctccagctgcaacatcgtcatcctttagctcagcgaacgctgggcgaacgctccctccccgcccctcctgcccctcctccctactccaagccctcggcttctcatccgctgaacgatgtcctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagaggtgagtgcctccgcagccccgccgcccgccgtggggtcggggacagggagaagggagtgcctgcctggtctgcgccccccgcctgtcagcccttgcctcgaggctctggggcacccaactcgtcgactcctgacaccgcagcggggtaggctgctggacagccccgagcgcctgcagctgctgctgccatctctgatctacatgcttccagctctgccagtggcagcccccctgctgctcgcagtctgatcagcaacccctcgggtcctcgcatcttccctgctgcgcgctcctgtcccagcgcggccgccgagatttccgaccttgtcccaggcagggcggtagcgttccggatcagtccttgcctccgtgcccccacgcacaggcagctccaggagcagcggccagcaacccttctggggacaccttactgtagtccggcaggacagccgatcagagccgctctagggggtggtcggagtgcccatttcggctggaatcccaactcggctccttgctctgtgaccttggggtagttagttgacttctctgaacctcgggttcctcatcggtgtaatgagcaaaacataaacaatctttttctcacagttgaggttatccacaggaagcatttaggagaactggctcaggtagacatcagtaactattagctggaattcggttaccactattgcattccttcctagcactgccaggggcctgggaattccctctcccaggtatttccatatcctgtcaggtattcccccacctattggaatagctctgcctacatggttctaataggaccaagagattggcgtcaagtccaaggggcaccattattatctgcattacttagattgcagatgatgacagtaagatcagggaacagtgttacccttagacccacccacagtattaccagtgcctatgttgctatggctaactttgctatttataacagcatcatccacatttcagattctatacgagagggatctgcaactgctcggctggtgtcattgctaatagtattattagttttgcttccaataaaaaggactatttatatgatgattgcaattacttctacaggccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggctgccggctgatgggcattcagcatggaggtggtgggtgttgttagatgtgtgtacacacgtgcatgcctacacacacacacacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcaggtaagcaaccccacttggggtcaccgtctctgtcttgttcagccctaaccaactgcttccaggcttaggggccccaggaagagagagaattggagggctgtggggaagcgtccaggctggaacacttggaaataagggctgagctgtgagcatctggtgggttggagaaatcatggggcaggactagggaagggcactgggtgcaaggctttgggcccctaaggtggaggataggggatcctgaagctaggaggtgggaaaggggtggaactgggagaaaccctgaaggaggccctaaagggagcagactgggaaactgggctggaggactcagggggcgaggttggaggaccctggggtgtggtctaggaattttggagaggaagtggaagactctgagagcagggcaaggaatcctgggggctgaattgactgggagactttgggggatgggtctggagaccgtcggggtggtcctggaggacctagaggtagggctgcaggaccctggcccctggcccctggcccctggtcctaggggggccggggaatcctggggccggaaggagggatcctggagcggggcttggaggccaccgggtgggactctgagggtcgacagcgttaagttccagccggctccacccgttcacagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304966 - DNA, 7052 bp, Homo sapiens
gagttcctggctgggcagcactcaaggcccaccccctggcatcaggctgcacattcagcatcgacagccctggccagtaggccttctgggctcccagcaacgcctgcattttccacattggtttgcatgactggtaatgtcccttcacagggccaccctcaccccacccccaccccaggtctagagatttcctgaattgctttgcttaacccatgattctgctgtctaacctccatccttccagctgcaaagtcagctcctcctctgtgcagggagtgggagcaccacaggagccaatgcccaatcatagctgcctccagggaggtagctacggtcctttgcaccccattctgcctccagaatatgagttttccattttttttattagaaagggtgtctcttttcaggagcaaagcccccattctcccttcatccacttcttacagtctaattgactccctcctccttcttctttgaacaacgagaagactctccagttgtccaacttccacccctccagctgcaacatcgtcatcctttagctcagcgaacgctgggcgaacgctccctccccgcccctcctgcccctcctccctactccaagccctcggcttctcatccgctgaacgatgtcctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagaggtgagtgcctccgcagccccgccgcccgccgtggggtcggggacagggagaagggagtgcctgcctggtctgcgccccccgcctgtcagcccttgcctcgaggctctggggcacccaactcgtcgactcctgacaccgcagcggggtaggctgctggacagccccgagcgcctgcagctgctgctgccatctctgatctacatgcttccagctctgccagtggcagcccccctgctgctcgcagtctgatcagcaacccctcgggtcctcgcatcttccctgctgcgcgctcctgtcccagcgcggccgccgagatttccgaccttgtcccaggcagggcggtagcgttccggatcagtccttgcctccgtgcccccacgcacaggcagctccaggagcagcggccagcaacccttctggggacaccttactgtagtccggcaggacagccgatcagagccgctctagggggtggtcggagtgcccatttcggctggaatcccaactcggctccttgctctgtgaccttggggtagttagttgacttctctgaacctcgggttcctcatcggtgtaatgagcaaaacataaacaatctttttctcacagttgaggttatccacaggaagcatttaggagaactggctcaggtagacatcagtaactattagctggaattcggttaccactattgcattccttcctagcactgccaggggcctgggaattccctctcccaggtatttccatatcctgtcaggtattcccccacctattggaatagctctgcctacatggttctaataggaccaagagattggcgtcaagtccaaggggcaccattattatctgcattacttagattgcagatgatgacagtaagatcagggaacagtgttacccttagacccacccacagtattaccagtgcctatgttgctatggctaactttgctatttataacagcatcatccacatttcagattctatacgagagggatctgcaactgctcggctggtgtcattgctaatagtattattagttttgcttccaataaaaaggactatttatatgatgattgcaattacttctacaggccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggctgccggctgatgggcattcagcatggaggtggtgggtgttgttagatgtgtgtacacacgtgcatgcctacacacacacacacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcaggtaagcaaccccacttggggtcaccgtctctgtcttgttcagccctaaccaactgcttccaggcttaggggccccaggaagagagagaattggagggctgtggggaagcgtccaggctggaacacttggaaataagggctgagctgtgagcatctggtgggttggagaaatcatggggcaggactagggaagggcactgggtgcaaggctttgggcccctaaggtggaggataggggatcctgaagctaggaggtgggaaaggggtggaactgggagaaaccctgaaggaggccctaaagggagcagactgggaaactgggctggaggactcagggggcgaggttggaggaccctggggtgtggtctaggaattttggagaggaagtggaagactctgagagcagggcaaggaatcctgggggctgaattgactgggagactttgggggatgggtctggagaccgtcggggtggtcctggaggacctagaggtagggctgcaggaccctggcccctggcccctggcccctggtcctaggggggccggggaatcctggggccggaaggagggatcctggagcggggcttggaggccaccgggtgggactctgagggtcgacagcgttaagttccagccggctccacccgttcacagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggtggaggacattctacccacaatctaacttaagtccctcatgctgtagagggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304967 - DNA, 4189 bp, Homo sapiens
  misc_feature (32)..(33): n is a, c, g, or t
ctgtcggccggaagtattggattgtcgacccnncgtcgcgtctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaaaaaaaacaaaaaaaacaacaaaagaaaaccaaaaaaaaaaaaaaaaaaaagagggggggcgcgcgcgcctccaaaaatatatcatccccgcgcggggggccccaatttcacgcgccgtccccgcgatttttgtgggaacagagggggcccccaaaagagggagcgcgcgcagtatatatatataagacagagagacgcgcggggggcgcgcgcgcgtttaaaaccaagggcgggagaggggggaaaaggcgggaaaccggggacacacacggggggaagagggcccctatacccgggggggggggcaccatagggggccaaaatacccaacaaggaaattaagaaggccccaaggggggaaaattttcacaccttacagagagggatcacagcgtggcttcacccccagagggaaacatattgcctagcgccatctataaacaaaatttgtgccacggcgcacaaataattggagcaccattttttcccgacgcctgtgttgacgtacaaaagaggacagtgaacaaacaagcaaaaaacacggcacaagaggacgaaaacagaagcacaagcgagaggtagacaagggcaggagagaaatcatcaacgagacagaaaggagcagagagtggagaacaccgacgaagtgaaagacgaacaacaaaaaacagatgggtaacaaaacaacaccacagaagaagaggagagaaagcaaacacagaacaccacacccgacgcgagggaagaataagaacagcagacgcacaagaggaaaaccacagaagcaagaacagaaagagagaaacgacaaggggagtcagcaaccgacgagccaaaacagggaagaaaagaggacggaagagaccgcgacaacaaacaaagagagaaa

SEQ ID NO: 304968 - DNA, 3376 bp, Homo sapiens
  misc_feature (32)..(33): n is a, c, g, or t
  misc_feature (3359)..(3359): n is a, c, g, or t
  misc_feature (3361)..(3361): n is a, c, g, or t
  misc_feature (3367)..(3367): n is a, c, g, or t
  misc_feature (3371)..(3371): n is a, c, g, or t
ctgtcggccggaagtattggattgtcgacccnncgtcgcgtctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaaaaaaaacaaaaaaaacaacaaaagaaaaccaaaaaaaaaaaagggggggcgcccacaananaacacncccnggggg

SEQ ID NO: 304969 - DNA, 3415 bp, Homo sapiens
  misc_feature (32)..(33): n is a, c, g, or t
  misc_feature (3398)..(3398): n is a, c, g, or t
  misc_feature (3400)..(3400): n is a, c, g, or t
  misc_feature (3406)..(3406): n is a, c, g, or t
  misc_feature (3410)..(3410): n is a, c, g, or t
ctgtcggccggaagtattggattgtcgacccnncgtcgcgtctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaaaaaaaaaaaaaaaaaaaaaaaaaaaaaaaaaaaaaaaacaaaaaacaaaaaaaacaacaaaagaaaaccaaaaaaaaaaaagggggggcgcccacaananaacacncccnggggg

SEQ ID NO: 304970 - DNA, 3310 bp, Homo sapiens
  misc_feature (32)..(33): n is a, c, g, or t
  misc_feature (3297)..(3297): n is a, c, g, or t
  misc_feature (3303)..(3303): n is a, c, g, or t
ctgtcggccggaagtattggattgtcgacccnncgtcgcgtctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctgttcctctagggcgcactgtgcccctctttcgggcccttccggggctgggtcgtcgactccctgccgccgcggcggcgggtncgcgancccttta

SEQ ID NO: 304971 - DNA, 6037 bp, Homo sapiens
  misc_feature (32)..(33): n is a, c, g, or t
ctgtcggccggaagtattggattgtcgacccnncgtcgcgtctcgcgcagtctccgccgcagtctcagctgcagctgcaggactgagccgtgcacccggaggagacccccggaggaggcgacaaacttcgcagtgccgcgacccaaccccagccctgggtagaggtgagtgcctccgcagccccgccgcccgccgtggggtcggggacagggagaagggagtgcctgcctggtctgcgccccccgcctgtcagcccttgcctcgaggctctggggcacccaactcgtcgactcctgacaccgcagcggggtaggctgctggacagccccgagcgcctgcagctgctgctgccatctctgatctacatgcttccagctctgccagtggcagcccccctgctgctcgcagtctgatcagcaacccctcgggtcctcgcatcttccctgctgcgcgctcctgtcccagcgcggccgccgagatttccgaccttgtcccaggcagggcggtagcgttccggatcagtccttgctctgtgaccttggggtagttagttgacttctctgaacctcgggttcctcatcggtgtaatgagcaaaacataaacaatctttttctcacagttgaggttatccacaggaagcatttaggagaactggctcaggtagacatcagtaactattagctggaattcggttaccactattgcattccttcctagcactgccaggggcctgggaattccctctcccaggtatttccatatcctgtcaggtattcccccacctattggaatagctctgcctacatggttctaataggaccaagagattggcgtcaagtccaaggggcaccattattatctgcattacttagattgcagatgatgacagtaagatcagggaacagtgttacccttagacccacccacagtattaccagtgcctatgttgctatggctaactttgctatttataacagcatcatccacatttcagattctatacgagagggatctgcaactgctcggctggtgtcattgctaatagtattattagttttgcttccaataaaaaggactatttatatgatgattgcaattacttctacaggccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggctgccggctgatgggcattcagcatggaggtggtgggtgttgttagatgtgtgtacacacgtgcatgcctacacacacacacacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcaggtaagcaaccccacttggggtcaccgtctctgtcttgttcagccctaaccaactgcttccaggcttaggggccccaggaagagagagaattggagggctgtggggaagcgtccaggctggaacacttggaaataagggctgagctgtgagcatctggtgggttggagaaatcatggggcaggactagggaagggcactgggtgcaaggctttgggcccctaaggtggaggataggggatcctgaagctaggaggtgggaaaggggtggaactgggagaaaccctgaaggaggccctaaagggagcagactgggaaactgggctggaggactcagggggcgaggttggaggaccctggggtgtggtctaggaattttggagaggaagtggaagactctgagagcagggcaaggaatcctgggggctgaattgactgggagactttgggggatgggtctggagaccgtcggggtggtcctggaggacctagaggtagggctgcaggaccctggcccctggcccctggcccctggtcctaggggggccggggaatcctggggccggaaggagggatcctggagcggggcttggaggccaccgggtgggactctgagggtcgacagcgttaagttccagccggctccacccgttcacagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304972 - DNA, 4932 bp, Homo sapiens
agctgctcttgaggatccctgtaactcagtcagctcatgttgctcctcatgaagccgttaagggggtagcagagagcttccctcctgctatagccaaagctctggcttcttgtgcctccctgctgaccctgctgagtgctggagctcagttcctatgggacagaccttggctgccggctgatgggcattcagcatggaggtggtgggtgttgttagatgtgtgtacacacgtgcatgcctacacacacacacacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcaggtaagcaaccccacttggggtcaccgtctctgtcttgttcagccctaaccaactgcttccaggcttaggggccccaggaagagagagaattggagggctgtggggaagcgtccaggctggaacacttggaaataagggctgagctgtgagcatctggtgggttggagaaatcatggggcaggactagggaagggcactgggtgcaaggctttgggcccctaaggtggaggataggggatcctgaagctaggaggtgggaaaggggtggaactgggagaaaccctgaaggaggccctaaagggagcagactgggaaactgggctggaggactcagggggcgaggttggaggaccctggggtgtggtctaggaattttggagaggaagtggaagactctgagagcagggcaaggaatcctgggggctgaattgactgggagactttgggggatgggtctggagaccgtcggggtggtcctggaggacctagaggtagggctgcaggaccctggcccctggcccctggcccctggtcctaggggggccggggaatcctggggccggaaggagggatcctggagcggggcttggaggccaccgggtgggactctgagggtcgacagcgttaagttccagccggctccacccgttcacagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304973 - DNA, 7102 bp, Homo sapiens
gagttcctggctgggcagcactcaaggcccaccccctggcatcaggctgcacattcagcatcgacagccctggccagtaggccttctgggctcccagcaacgcctgcattttccacattggtttgcatgactggtaatgtcccttcacagggccaccctcaccccacccccaccccaggtctagagatttcctgaattgctttgcttaacccatgattctgctgtctaacctccatccttccagctgcaaagtcagctcctcctctgtgcagggagtgggagcaccacaggagccaatgcccaatcatagctgcctccagggaggtagctacggtcctttgcaccccattctgcctccagaatatgagttttccattttttttattagaaagggtgtctcttttcaggagcaaagcccccattctcccttcatccacttcttacagtctaattgactccctcctccttcttctttgaacaacgagaagactctccagttgtccaacttccacccctccagctgcaacatcgtcatcctttagctcagcgaacgctgggcgaacgctccctccccgcccctcctgcccctcctccctactccaagccctcggcttctcatccgctgaacgatgtcctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagaggtgagtgcctccgcagccccgccgcccgccgtggggtcggggacagggagaagggagtgcctgcctggtctgcgccccccgcctgtcagcccttgcctcgaggctctggggcacccaactcgtcgactcctgacaccgcagcggggtaggctgctggacagccccgagcgcctgcagctgctgctgccatctctgatctacatgcttccagctctgccagtggcagcccccctgctgctcgcagtctgatcagcaacccctcgggtcctcgcatcttccctgctgcgcgctcctgtcccagcgcggccgccgagatttccgaccttgtcccaggcagggcggtagcgttccggatcagtccttgcctccgtgcccccacgcacaggcagctccaggagcagcggccagcaacccttctggggacaccttactgtagtccggcaggacagccgatcagagccgctctagggggtggtcggagtgcccatttcggctggaatcccaactcggctccttgctctgtgaccttggggtagttagttgacttctctgaacctcgggttcctcatcggtgtaatgagcaaaacataaacaatctttttctcacagttgaggttatccacaggaagcatttaggagaactggctcaggtagacatcagtaactattagctggaattcggttaccactattgcattccttcctagcactgccaggggcctgggaattccctctcccaggtatttccatatcctgtcaggtattcccccacctattggaatagctctgcctacatggttctaataggaccaagagattggcgtcaagtccaaggggcaccattattatctgcattacttagattgcagatgatgacagtaagatcagggaacagtgttacccttagacccacccacagtattaccagtgcctatgttgctatggctaactttgctatttataacagcatcatccacatttcagattctatacgagagggatctgcaactgctcggctggtgtcattgctaatagtattattagttttgcttccaataaaaaggactatttatatgatgattgcaattacttctacaggccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggctgccggctgatgggcattcagcatggaggtggtgggtgttgttagatgtgtgtacacacgtgcatgcctacacacacacacacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcaggtaagcaaccccacttggggtcaccgtctctgtcttgttcagccctaaccaactgcttccaggcttaggggccccaggaagagagagaattggagggctgtggggaagcgtccaggctggaacacttggaaataagggctgagctgtgagcatctggtgggttggagaaatcatggggcaggactagggaagggcactgggtgcaaggctttgggcccctaaggtggaggataggggatcctgaagctaggaggtgggaaaggggtggaactgggagaaaccctgaaggaggccctaaagggagcagactgggaaactgggctggaggactcagggggcgaggttggaggaccctggggtgtggtctaggaattttggagaggaagtggaagactctgagagcagggcaaggaatcctgggggctgaattgactgggagactttgggggatgggtctggagaccgtcggggtggtcctggaggacctagaggtagggctgcaggaccctggcccctggcccctggcccctggtcctaggggggccggggaatcctggggccggaaggagggatcctggagcggggcttggaggccaccgggtgggactctgagggtcgacagcgttaagttccagccggctccacccgttcacagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggttctctgtcactgtgacgatagcctctagtccatcagaggctgggttggaggctgggttggaggcctcagggatggcagaaggctgggccgagtctcggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304974 - DNA, 2711 bp, Homo sapiens
  misc_feature (23)..(23): n is a, c, g, or t
tgcggctggtacggaccgcgtantggatatcgtcgaccgcgccgtcggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304975 - DNA, 6737 bp, Homo sapiens
gagttcctggctgggcagcactcaaggcccaccccctggcatcaggctgcacattcagcatcgacagccctggccagtaggccttctgggctcccagcaacgcctgcattttccacattggtttgcatgactggtaatgtcccttcacagggccaccctcaccccacccccaccccaggtctagagatttcctgaattgctttgcttaacccatgattctgctgtctaacctccatccttccagctgcaaagtcagctcctcctctgtgcagggagtgggagcaccacaggagccaatgcccaatcatagctgcctccagggaggtagctacggtcctttgcaccccattctgcctccagaatatgagttttccattttttttattagaaagggtgtctcttttcaggagcaaagcccccattctcccttcatccacttcttacagtctaattgactccctcctccttcttctttgaacaacgagaagactctccagttgtccaacttccacccctccagctgcaacatcgtcatcctttagctcagcgaacgctgggcgaacgctccctccccgcccctcctgcccctcctccctactccaagccctcggcttctcatccgctgaacgatgtcctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagaggtgagtgcctccgcagccccgccgcccgccgtggggtcggggacagggagaagggagtgcctgcctggtctgcgccccccgcctgtcagcccttgcctcgaggctctggggcacccaactcgtcgactcctgacaccgcagcggggtaggctgctggacagccccgagcgcctgcagctgctgctgccatctctgatctacatgcttccagctctgccagtggcagcccccctgctgctcgcagtctgatcagcaacccctcgggtcctcgcatcttccctgctgcgcgctcctgtcccagcgcggccgccgagatttccgaccttgtcccaggcagggcggtagcgttccggatcagtccttgcctccgtgcccccacgcacaggcagctccaggagcagcggccagcaacccttctggggacaccttactgtagtccggcaggacagccgatcagagccgctctagggggtggtcggagtgcccatttcggctggaatcccaactcggctccttgctctgtgaccttggggtagttagttgacttctctgaacctcgggttcctcatcggtgtaatgagcaaaacataaacaatctttttctcacagttgaggttatccacaggaagcatttaggagaactggctcaggtagacatcagtaactattagctggaattcggttaccactattgcattccttcctagcactgccaggggcctgggaattccctctcccaggtatttccatatcctgtcaggtattcccccacctattggaatagctctgcctacatggttctaataggaccaagagattggcgtcaagtccaaggggcaccattattatctgcattacttagattgcagatgatgacagtaagatcagggaacagtgttacccttagacccacccacagtattaccagtgcctatgttgctatggctaactttgctatttataacagcatcatccacatttcagattctatacgagagggatctgcaactgctcggctggtgtcattgctaatagtattattagttttgcttccaataaaaaggactatttatatgatgattgcaattacttctacaggccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggctgccggctgatgggcattcagcatggaggtggtgggtgttgttagatgtgtgtacacacgtgcatgcctacacacacacacacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcaggtaagcaaccccacttggggtcaccgtctctgtcttgttcagccctaaccaactgcttccaggcttaggggccccaggaagagagagaattggagggctgtggggaagcgtccaggctggaacacttggaaataagggctgagctgtgagcatctggtgggttggagaaatcatggggcaggactagggaagggcactgggtgcaaggctttgggcccctaaggtggaggataggggatcctgaagctaggaggtgggaaaggggtggaactgggagaaaccctgaaggaggccctaaagggagcagactgggaaactgggctggaggactcagggggcgaggttggaggaccctggggtgtggtctaggaattttggagaggaagtggaagactctgagagcagggcaaggaatcctgggggctgaattgactgggagactttgggggatgggtctggagaccgtcggggtggtcctggaggacctagaggtagggctgcaggaccctggcccctggcccctggcccctggtcctaggggggccggggaatcctggggccggaaggagggatcctggagcggggcttggaggccaccgggtgggactctgagggtcgacagcgttaagttccagccggctccacccgttcacagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccccgtttgtgctttgcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304976 - DNA, 6651 bp, Homo sapiens
gagttcctggctgggcagcactcaaggcccaccccctggcatcaggctgcacattcagcatcgacagccctggccagtaggccttctgggctcccagcaacgcctgcattttccacattggtttgcatgactggtaatgtcccttcacagggccaccctcaccccacccccaccccaggtctagagatttcctgaattgctttgcttaacccatgattctgctgtctaacctccatccttccagctgcaaagtcagctcctcctctgtgcagggagtgggagcaccacaggagccaatgcccaatcatagctgcctccagggaggtagctacggtcctttgcaccccattctgcctccagaatatgagttttccattttttttattagaaagggtgtctcttttcaggagcaaagcccccattctcccttcatccacttcttacagtctaattgactccctcctccttcttctttgaacaacgagaagactctccagttgtccaacttccacccctccagctgcaacatcgtcatcctttagctcagcgaacgctgggcgaacgctccctccccgcccctcctgcccctcctccctactccaagccctcggcttctcatccgctgaacgatgtcctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagaggtgagtgcctccgcagccccgccgcccgccgtggggtcggggacagggagaagggagtgcctgcctggtctgcgccccccgcctgtcagcccttgcctcgaggctctggggcacccaactcgtcgactcctgacaccgcagcggggtaggctgctggacagccccgagcgcctgcagctgctgctgccatctctgatctacatgcttccagctctgccagtggcagcccccctgctgctcgcagtctgatcagcaacccctcgggtcctcgcatcttccctgctgcgcgctcctgtcccagcgcggccgccgagatttccgaccttgtcccaggcagggcggtagcgttccggatcagtccttgcctccgtgcccccacgcacaggcagctccaggagcagcggccagcaacccttctggggacaccttactgtagtccggcaggacagccgatcagagccgctctagggggtggtcggagtgcccatttcggctggaatcccaactcggctccttgctctgtgaccttggggtagttagttgacttctctgaacctcgggttcctcatcggtgtaatgagcaaaacataaacaatctttttctcacagttgaggttatccacaggaagcatttaggagaactggctcaggtagacatcagtaactattagctggaattcggttaccactattgcattccttcctagcactgccaggggcctgggaattccctctcccaggtatttccatatcctgtcaggtattcccccacctattggaatagctctgcctacatggttctaataggaccaagagattggcgtcaagtccaaggggcaccattattatctgcattacttagattgcagatgatgacagtaagatcagggaacagtgttacccttagacccacccacagtattaccagtgcctatgttgctatggctaactttgctatttataacagcatcatccacatttcagattctatacgagagggatctgcaactgctcggctggtgtcattgctaatagtattattagttttgcttccaataaaaaggactatttatatgatgattgcaattacttctacaggccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggctgccggctgatgggcattcagcatggaggtggtgggtgttgttagatgtgtgtacacacgtgcatgcctacacacacacacacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcaggtaagcaaccccacttggggtcaccgtctctgtcttgttcagccctaaccaactgcttccaggcttaggggccccaggaagagagagaattggagggctgtggggaagcgtccaggctggaacacttggaaataagggctgagctgtgagcatctggtgggttggagaaatcatggggcaggactagggaagggcactgggtgcaaggctttgggcccctaaggtggaggataggggatcctgaagctaggaggtgggaaaggggtggaactgggagaaaccctgaaggaggccctaaagggagcagactgggaaactgggctggaggactcagggggcgaggttggaggaccctggggtgtggtctaggaattttggagaggaagtggaagactctgagagcagggcaaggaatcctgggggctgaattgactgggagactttgggggatgggtctggagaccgtcggggtggtcctggaggacctagaggtagggctgcaggaccctggcccctggcccctggcccctggtcctaggggggccggggaatcctggggccggaaggagggatcctggagcggggcttggaggccaccgggtgggactctgagggtcgacagcgttaagttccagccggctccacccgttcacagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggccccagtatcgaccttgtcaacgacgtccagtgtccataccgtgcacgacctcctgtcactcgacatacccgcctcagcgcat

SEQ ID NO: 304977 - DNA, 1739 bp, Homo sapiens
ttacggtatcgtcgatccacgcgctctggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304978 - DNA, 1714 bp, Homo sapiens
taatctagaggatcccagttcacggagtactccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304979 - DNA, 7581 bp, Homo sapiens
gagttcctggctgggcagcactcaaggcccaccccctggcatcaggctgcacattcagcatcgacagccctggccagtaggccttctgggctcccagcaacgcctgcattttccacattggtttgcatgactggtaatgtcccttcacagggccaccctcaccccacccccaccccaggtctagagatttcctgaattgctttgcttaacccatgattctgctgtctaacctccatccttccagctgcaaagtcagctcctcctctgtgcagggagtgggagcaccacaggagccaatgcccaatcatagctgcctccagggaggtagctacggtcctttgcaccccattctgcctccagaatatgagttttccattttttttattagaaagggtgtctcttttcaggagcaaagcccccattctcccttcatccacttcttacagtctaattgactccctcctccttcttctttgaacaacgagaagactctccagttgtccaacttccacccctccagctgcaacatcgtcatcctttagctcagcgaacgctgggcgaacgctccctccccgcccctcctgcccctcctccctactccaagccctcggcttctcatccgctgaacgatgtcctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagaggtgagtgcctccgcagccccgccgcccgccgtggggtcggggacagggagaagggagtgcctgcctggtctgcgccccccgcctgtcagcccttgcctcgaggctctggggcacccaactcgtcgactcctgacaccgcagcggggtaggctgctggacagccccgagcgcctgcagctgctgctgccatctctgatctacatgcttccagctctgccagtggcagcccccctgctgctcgcagtctgatcagcaacccctcgggtcctcgcatcttccctgctgcgcgctcctgtcccagcgcggccgccgagatttccgaccttgtcccaggcagggcggtagcgttccggatcagtccttgcctccgtgcccccacgcacaggcagctccaggagcagcggccagcaacccttctggggacaccttactgtagtccggcaggacagccgatcagagccgctctagggggtggtcggagtgcccatttcggctggaatcccaactcggctccttgctctgtgaccttggggtagttagttgacttctctgaacctcgggttcctcatcggtgtaatgagcaaaacataaacaatctttttctcacagttgaggttatccacaggaagcatttaggagaactggctcaggtagacatcagtaactattagctggaattcggttaccactattgcattccttcctagcactgccaggggcctgggaattccctctcccaggtatttccatatcctgtcaggtattcccccacctattggaatagctctgcctacatggttctaataggaccaagagattggcgtcaagtccaaggggcaccattattatctgcattacttagattgcagatgatgacagtaagatcagggaacagtgttacccttagacccacccacagtattaccagtgcctatgttgctatggctaactttgctatttataacagcatcatccacatttcagattctatacgagagggatctgcaactgctcggctggtgtcattgctaatagtattattagttttgcttccaataaaaaggactatttatatgatgattgcaattacttctacaggccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggctgccggctgatgggcattcagcatggaggtggtgggtgttgttagatgtgtgtacacacgtgcatgcctacacacacacacacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcaggtaagcaaccccacttggggtcaccgtctctgtcttgttcagccctaaccaactgcttccaggcttaggggccccaggaagagagagaattggagggctgtggggaagcgtccaggctggaacacttggaaataagggctgagctgtgagcatctggtgggttggagaaatcatggggcaggactagggaagggcactgggtgcaaggctttgggcccctaaggtggaggataggggatcctgaagctaggaggtgggaaaggggtggaactgggagaaaccctgaaggaggccctaaagggagcagactgggaaactgggctggaggactcagggggcgaggttggaggaccctggggtgtggtctaggaattttggagaggaagtggaagactctgagagcagggcaaggaatcctgggggctgaattgactgggagactttgggggatgggtctggagaccgtcggggtggtcctggaggacctagaggtagggctgcaggaccctggcccctggcccctggcccctggtcctaggggggccggggaatcctggggccggaaggagggatcctggagcggggcttggaggccaccgggtgggactctgagggtcgacagcgttaagttccagccggctccacccgttcacagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304980 - DNA, 1752 bp, Homo sapiens
  misc_feature (32)..(33): n is a, c, g, or t
ctgtcggccggaagtattggattgtcgacccnncgtcgcgtctcgcgcagtctccgccgcagtctcagctgcagctgcaggactgagccgtgcacccggaggagacccccggaggaggcgacaaacttcgcagtgccgcgacccaaccccagccctgggtagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304981 - DNA, 8129 bp, Homo sapiens
gagttcctggctgggcagcactcaaggcccaccccctggcatcaggctgcacattcagcatcgacagccctggccagtaggccttctgggctcccagcaacgcctgcattttccacattggtttgcatgactggtaatgtcccttcacagggccaccctcaccccacccccaccccaggtctagagatttcctgaattgctttgcttaacccatgattctgctgtctaacctccatccttccagctgcaaagtcagctcctcctctgtgcagggagtgggagcaccacaggagccaatgcccaatcatagctgcctccagggaggtagctacggtcctttgcaccccattctgcctccagaatatgagttttccattttttttattagaaagggtgtctcttttcaggagcaaagcccccattctcccttcatccacttcttacagtctaattgactccctcctccttcttctttgaacaacgagaagactctccagttgtccaacttccacccctccagctgcaacatcgtcatcctttagctcagcgaacgctgggcgaacgctccctccccgcccctcctgcccctcctccctactccaagccctcggcttctcatccgctgaacgatgtcctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagaggtgagtgcctccgcagccccgccgcccgccgtggggtcggggacagggagaagggagtgcctgcctggtctgcgccccccgcctgtcagcccttgcctcgaggctctggggcacccaactcgtcgactcctgacaccgcagcggggtaggctgctggacagccccgagcgcctgcagctgctgctgccatctctgatctacatgcttccagctctgccagtggcagcccccctgctgctcgcagtctgatcagcaacccctcgggtcctcgcatcttccctgctgcgcgctcctgtcccagcgcggccgccgagatttccgaccttgtcccaggcagggcggtagcgttccggatcagtccttgcctccgtgcccccacgcacaggcagctccaggagcagcggccagcaacccttctggggacaccttactgtagtccggcaggacagccgatcagagccgctctagggggtggtcggagtgcccatttcggctggaatcccaactcggctccttgctctgtgaccttggggtagttagttgacttctctgaacctcgggttcctcatcggtgtaatgagcaaaacataaacaatctttttctcacagttgaggttatccacaggaagcatttaggagaactggctcaggtagacatcagtaactattagctggaattcggttaccactattgcattccttcctagcactgccaggggcctgggaattccctctcccaggtatttccatatcctgtcaggtattcccccacctattggaatagctctgcctacatggttctaataggaccaagagattggcgtcaagtccaaggggcaccattattatctgcattacttagattgcagatgatgacagtaagatcagggaacagtgttacccttagacccacccacagtattaccagtgcctatgttgctatggctaactttgctatttataacagcatcatccacatttcagattctatacgagagggatctgcaactgctcggctggtgtcattgctaatagtattattagttttgcttccaataaaaaggactatttatatgatgattgcaattacttctacaggccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggctgccggctgatgggcattcagcatggaggtggtgggtgttgttagatgtgtgtacacacgtgcatgcctacacacacacacacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcaggtaagcaaccccacttggggtcaccgtctctgtcttgttcagccctaaccaactgcttccaggcttaggggccccaggaagagagagaattggagggctgtggggaagcgtccaggctggaacacttggaaataagggctgagctgtgagcatctggtgggttggagaaatcatggggcaggactagggaagggcactgggtgcaaggctttgggcccctaaggtggaggataggggatcctgaagctaggaggtgggaaaggggtggaactgggagaaaccctgaaggaggccctaaagggagcagactgggaaactgggctggaggactcagggggcgaggttggaggaccctggggtgtggtctaggaattttggagaggaagtggaagactctgagagcagggcaaggaatcctgggggctgaattgactgggagactttgggggatgggtctggagaccgtcggggtggtcctggaggacctagaggtagggctgcaggaccctggcccctggcccctggcccctggtcctaggggggccggggaatcctggggccggaaggagggatcctggagcggggcttggaggccaccgggtgggactctgagggtcgacagcgttaagttccagccggctccacccgttcacagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304982 - DNA, 6744 bp, Homo sapiens
gagttcctggctgggcagcactcaaggcccaccccctggcatcaggctgcacattcagcatcgacagccctggccagtaggccttctgggctcccagcaacgcctgcattttccacattggtttgcatgactggtaatgtcccttcacagggccaccctcaccccacccccaccccaggtctagagatttcctgaattgctttgcttaacccatgattctgctgtctaacctccatccttccagctgcaaagtcagctcctcctctgtgcagggagtgggagcaccacaggagccaatgcccaatcatagctgcctccagggaggtagctacggtcctttgcaccccattctgcctccagaatatgagttttccattttttttattagaaagggtgtctcttttcaggagcaaagcccccattctcccttcatccacttcttacagtctaattgactccctcctccttcttctttgaacaacgagaagactctccagttgtccaacttccacccctccagctgcaacatcgtcatcctttagctcagcgaacgctgggcgaacgctccctccccgcccctcctgcccctcctccctactccaagccctcggcttctcatccgctgaacgatgtcctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagaggtgagtgcctccgcagccccgccgcccgccgtggggtcggggacagggagaagggagtgcctgcctggtctgcgccccccgcctgtcagcccttgcctcgaggctctggggcacccaactcgtcgactcctgacaccgcagcggggtaggctgctggacagccccgagcgcctgcagctgctgctgccatctctgatctacatgcttccagctctgccagtggcagcccccctgctgctcgcagtctgatcagcaacccctcgggtcctcgcatcttccctgctgcgcgctcctgtcccagcgcggccgccgagatttccgaccttgtcccaggcagggcggtagcgttccggatcagtccttgcctccgtgcccccacgcacaggcagctccaggagcagcggccagcaacccttctggggacaccttactgtagtccggcaggacagccgatcagagccgctctagggggtggtcggagtgcccatttcggctggaatcccaactcggctccttgctctgtgaccttggggtagttagttgacttctctgaacctcgggttcctcatcggtgtaatgagcaaaacataaacaatctttttctcacagttgaggttatccacaggaagcatttaggagaactggctcaggtagacatcagtaactattagctggaattcggttaccactattgcattccttcctagcactgccaggggcctgggaattccctctcccaggtatttccatatcctgtcaggtattcccccacctattggaatagctctgcctacatggttctaataggaccaagagattggcgtcaagtccaaggggcaccattattatctgcattacttagattgcagatgatgacagtaagatcagggaacagtgttacccttagacccacccacagtattaccagtgcctatgttgctatggctaactttgctatttataacagcatcatccacatttcagattctatacgagagggatctgcaactgctcggctggtgtcattgctaatagtattattagttttgcttccaataaaaaggactatttatatgatgattgcaattacttctacaggccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggctgccggctgatgggcattcagcatggaggtggtgggtgttgttagatgtgtgtacacacgtgcatgcctacacacacacacacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcaggtaagcaaccccacttggggtcaccgtctctgtcttgttcagccctaaccaactgcttccaggcttaggggccccaggaagagagagaattggagggctgtggggaagcgtccaggctggaacacttggaaataagggctgagctgtgagcatctggtgggttggagaaatcatggggcaggactagggaagggcactgggtgcaaggctttgggcccctaaggtggaggataggggatcctgaagctaggaggtgggaaaggggtggaactgggagaaaccctgaaggaggccctaaagggagcagactgggaaactgggctggaggactcagggggcgaggttggaggaccctggggtgtggtctaggaattttggagaggaagtggaagactctgagagcagggcaaggaatcctgggggctgaattgactgggagactttgggggatgggtctggagaccgtcggggtggtcctggaggacctagaggtagggctgcaggaccctggcccctggcccctggcccctggtcctaggggggccggggaatcctggggccggaaggagggatcctggagcggggcttggaggccaccgggtgggactctgagggtcgacagcgttaagttccagccggctccacccgttcacagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304983 - DNA, 6736 bp, Homo sapiens
gagttcctggctgggcagcactcaaggcccaccccctggcatcaggctgcacattcagcatcgacagccctggccagtaggccttctgggctcccagcaacgcctgcattttccacattggtttgcatgactggtaatgtcccttcacagggccaccctcaccccacccccaccccaggtctagagatttcctgaattgctttgcttaacccatgattctgctgtctaacctccatccttccagctgcaaagtcagctcctcctctgtgcagggagtgggagcaccacaggagccaatgcccaatcatagctgcctccagggaggtagctacggtcctttgcaccccattctgcctccagaatatgagttttccattttttttattagaaagggtgtctcttttcaggagcaaagcccccattctcccttcatccacttcttacagtctaattgactccctcctccttcttctttgaacaacgagaagactctccagttgtccaacttccacccctccagctgcaacatcgtcatcctttagctcagcgaacgctgggcgaacgctccctccccgcccctcctgcccctcctccctactccaagccctcggcttctcatccgctgaacgatgtcctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagaggtgagtgcctccgcagccccgccgcccgccgtggggtcggggacagggagaagggagtgcctgcctggtctgcgccccccgcctgtcagcccttgcctcgaggctctggggcacccaactcgtcgactcctgacaccgcagcggggtaggctgctggacagccccgagcgcctgcagctgctgctgccatctctgatctacatgcttccagctctgccagtggcagcccccctgctgctcgcagtctgatcagcaacccctcgggtcctcgcatcttccctgctgcgcgctcctgtcccagcgcggccgccgagatttccgaccttgtcccaggcagggcggtagcgttccggatcagtccttgcctccgtgcccccacgcacaggcagctccaggagcagcggccagcaacccttctggggacaccttactgtagtccggcaggacagccgatcagagccgctctagggggtggtcggagtgcccatttcggctggaatcccaactcggctccttgctctgtgaccttggggtagttagttgacttctctgaacctcgggttcctcatcggtgtaatgagcaaaacataaacaatctttttctcacagttgaggttatccacaggaagcatttaggagaactggctcaggtagacatcagtaactattagctggaattcggttaccactattgcattccttcctagcactgccaggggcctgggaattccctctcccaggtatttccatatcctgtcaggtattcccccacctattggaatagctctgcctacatggttctaataggaccaagagattggcgtcaagtccaaggggcaccattattatctgcattacttagattgcagatgatgacagtaagatcagggaacagtgttacccttagacccacccacagtattaccagtgcctatgttgctatggctaactttgctatttataacagcatcatccacatttcagattctatacgagagggatctgcaactgctcggctggtgtcattgctaatagtattattagttttgcttccaataaaaaggactatttatatgatgattgcaattacttctacaggccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggctgccggctgatgggcattcagcatggaggtggtgggtgttgttagatgtgtgtacacacgtgcatgcctacacacacacacacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcaggtaagcaaccccacttggggtcaccgtctctgtcttgttcagccctaaccaactgcttccaggcttaggggccccaggaagagagagaattggagggctgtggggaagcgtccaggctggaacacttggaaataagggctgagctgtgagcatctggtgggttggagaaatcatggggcaggactagggaagggcactgggtgcaaggctttgggcccctaaggtggaggataggggatcctgaagctaggaggtgggaaaggggtggaactgggagaaaccctgaaggaggccctaaagggagcagactgggaaactgggctggaggactcagggggcgaggttggaggaccctggggtgtggtctaggaattttggagaggaagtggaagactctgagagcagggcaaggaatcctgggggctgaattgactgggagactttgggggatgggtctggagaccgtcggggtggtcctggaggacctagaggtagggctgcaggaccctggcccctggcccctggcccctggtcctaggggggccggggaatcctggggccggaaggagggatcctggagcggggcttggaggccaccgggtgggactctgagggtcgacagcgttaagttccagccggctccacccgttcacagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304984 - DNA, 6394 bp, Homo sapiens
gagttcctggctgggcagcactcaaggcccaccccctggcatcaggctgcacattcagcatcgacagccctggccagtaggccttctgggctcccagcaacgcctgcattttccacattggtttgcatgactggtaatgtcccttcacagggccaccctcaccccacccccaccccaggtctagagatttcctgaattgctttgcttaacccatgattctgctgtctaacctccatccttccagctgcaaagtcagctcctcctctgtgcagggagtgggagcaccacaggagccaatgcccaatcatagctgcctccagggaggtagctacggtcctttgcaccccattctgcctccagaatatgagttttccattttttttattagaaagggtgtctcttttcaggagcaaagcccccattctcccttcatccacttcttacagtctaattgactccctcctccttcttctttgaacaacgagaagactctccagttgtccaacttccacccctccagctgcaacatcgtcatcctttagctcagcgaacgctgggcgaacgctccctccccgcccctcctgcccctcctccctactccaagccctcggcttctcatccgctgaacgatgtcctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagaggtgagtgcctccgcagccccgccgcccgccgtggggtcggggacagggagaagggagtgcctgcctggtctgcgccccccgcctgtcagcccttgcctcgaggctctggggcacccaactcgtcgactcctgacaccgcagcggggtaggctgctggacagccccgagcgcctgcagctgctgctgccatctctgatctacatgcttccagctctgccagtggcagcccccctgctgctcgcagtctgatcagcaacccctcgggtcctcgcatcttccctgctgcgcgctcctgtcccagcgcggccgccgagatttccgaccttgtcccaggcagggcggtagcgttccggatcagtccttgcctccgtgcccccacgcacaggcagctccaggagcagcggccagcaacccttctggggacaccttactgtagtccggcaggacagccgatcagagccgctctagggggtggtcggagtgcccatttcggctggaatcccaactcggctccttgctctgtgaccttggggtagttagttgacttctctgaacctcgggttcctcatcggtgtaatgagcaaaacataaacaatctttttctcacagttgaggttatccacaggaagcatttaggagaactggctcaggtagacatcagtaactattagctggaattcggttaccactattgcattccttcctagcactgccaggggcctgggaattccctctcccaggtatttccatatcctgtcaggtattcccccacctattggaatagctctgcctacatggttctaataggaccaagagattggcgtcaagtccaaggggcaccattattatctgcattacttagattgcagatgatgacagtaagatcagggaacagtgttacccttagacccacccacagtattaccagtgcctatgttgctatggctaactttgctatttataacagcatcatccacatttcagattctatacgagagggatctgcaactgctcggctggtgtcattgctaatagtattattagttttgcttccaataaaaaggactatttatatgatgattgcaattacttctacaggccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggctgccggctgatgggcattcagcatggaggtggtgggtgttgttagatgtgtgtacacacgtgcatgcctacacacacacacacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcaggtaagcaaccccacttggggtcaccgtctctgtcttgttcagccctaaccaactgcttccaggcttaggggccccaggaagagagagaattggagggctgtggggaagcgtccaggctggaacacttggaaataagggctgagctgtgagcatctggtgggttggagaaatcatggggcaggactagggaagggcactgggtgcaaggctttgggcccctaaggtggaggataggggatcctgaagctaggaggtgggaaaggggtggaactgggagaaaccctgaaggaggccctaaagggagcagactgggaaactgggctggaggactcagggggcgaggttggaggaccctggggtgtggtctaggaattttggagaggaagtggaagactctgagagcagggcaaggaatcctgggggctgaattgactgggagactttgggggatgggtctggagaccgtcggggtggtcctggaggacctagaggtagggctgcaggaccctggcccctggcccctggcccctggtcctaggggggccggggaatcctggggccggaaggagggatcctggagcggggcttggaggccaccgggtgggactctgagggtcgacagcgttaagttccagccggctccacccgttcacagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaacca

SEQ ID NO: 304985 - DNA, 2691 bp, Homo sapiens
  misc_feature (32)..(33): n is a, c, g, or t
ctgtcggccggaagtattggattgtcgacccnncgtcgcgtctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaacca

SEQ ID NO: 304986 - DNA, 5302 bp, Homo sapiens
gagttcctggctgggcagcactcaaggcccaccccctggcatcaggctgcacattcagcatcgacagccctggccagtaggccttctgggctcccagcaacgcctgcattttccacattggtttgcatgactggtaatgtcccttcacagggccaccctcaccccacccccaccccaggtctagagatttcctgaattgctttgcttaacccatgattctgctgtctaacctccatccttccagctgcaaagtcagctcctcctctgtgcagggagtgggagcaccacaggagccaatgcccaatcatagctgcctccagggaggtagctacggtcctttgcaccccattctgcctccagaatatgagttttccattttttttattagaaagggtgtctcttttcaggagcaaagcccccattctcccttcatccacttcttacagtctaattgactccctcctccttcttctttgaacaacgagaagactctccagttgtccaacttccacccctccagctgcaacatcgtcatcctttagctcagcgaacgctgggcgaacgctccctccccgcccctcctgcccctcctccctactccaagccctcggcttctcatccgctgaacgatgtcctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagaggtgagtgcctccgcagccccgccgcccgccgtggggtcggggacagggagaagggagtgcctgcctggtctgcgccccccgcctgtcagcccttgcctcgaggctctggggcacccaactcgtcgactcctgacaccgcagcggggtaggctgctggacagccccgagcgcctgcagctgctgctgccatctctgatctacatgcttccagctctgccagtggcagcccccctgctgctcgcagtctgatcagcaacccctcgggtcctcgcatcttccctgctgcgcgctcctgtcccagcgcggccgccgagatttccgaccttgtcccaggcagggcggtagcgttccggatcagtccttgcctccgtgcccccacgcacaggcagctccaggagcagcggccagcaacccttctggggacaccttactgtagtccggcaggacagccgatcagagccgctctagggggtggtcggagtgcccatttcggctggaatcccaactcggctccttgctctgtgaccttggggtagttagttgacttctctgaacctcgggttcctcatcggtgtaatgagcaaaacataaacaatctttttctcacagttgaggttatccacaggaagcatttaggagaactggctcaggtagacatcagtaactattagctggaattcggttaccactattgcattccttcctagcactgccaggggcctgggaattccctctcccaggtatttccatatcctgtcaggtattcccccacctattggaatagctctgcctacatggttctaataggaccaagagattggcgtcaagtccaaggggcaccattattatctgcattacttagattgcagatgatgacagtaagatcagggaacagtgttacccttagacccacccacagtattaccagtgcctatgttgctatggctaactttgctatttataacagcatcatccacatttcagattctatacgagagggatctgcaactgctcggctggtgtcattgctaatagtattattagttttgcttccaataaaaaggactatttatatgatgattgcaattacttctacaggccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggctgccggctgatgggcattcagcatggaggtggtgggtgttgttagatgtgtgtacacacgtgcatgcctacacacacacacacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcaggtaagcaaccccacttggggtcaccgtctctgtcttgttcagccctaaccaactgcttccaggcttaggggccccaggaagagagagaattggagggctgtggggaagcgtccaggctggaacacttggaaataagggctgagctgtgagcatctggtgggttggagaaatcatggggcaggactagggaagggcactgggtgcaaggctttgggcccctaaggtggaggataggggatcctgaagctaggaggtgggaaaggggtggaactgggagaaaccctgaaggaggccctaaagggagcagactgggaaactgggctggaggactcagggggcgaggttggaggaccctggggtgtggtctaggaattttggagaggaagtggaagactctgagagcagggcaaggaatcctgggggctgaattgactgggagactttgggggatgggtctggagaccgtcggggtggtcctggaggacctagaggtagggctgcaggaccctggcccctggcccctggcccctggtcctaggggggccggggaatcctggggccggaaggagggatcctggagcggggcttggaggccaccgggtgggactctgagggtcgacagcgttaagttccagccggctccacccgttcacagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggaaacatgaaggaggagaagattcctagaaggaaatgtaagagctacaaaggagaaatgaagtgagagtctccgtcgaact

SEQ ID NO: 304987 - DNA, 4005 bp, Homo sapiens
gagttcctggctgggcagcactcaaggcccaccccctggcatcaggctgcacattcagcatcgacagccctggccagtaggccttctgggctcccagcaacgcctgcattttccacattggtttgcatgactggtaatgtcccttcacagggccaccctcaccccacccccaccccaggtctagagatttcctgaattgctttgcttaacccatgattctgctgtctaacctccatccttccagctgcaaagtcagctcctcctctgtgcagggagtgggagcaccacaggagccaatgcccaatcatagctgcctccagggaggtagctacggtcctttgcaccccattctgcctccagaatatgagttttccattttttttattagaaagggtgtctcttttcaggagcaaagcccccattctcccttcatccacttcttacagtctaattgactccctcctccttcttctttgaacaacgagaagactctccagttgtccaacttccacccctccagctgcaacatcgtcatcctttagctcagcgaacgctgggcgaacgctccctccccgcccctcctgcccctcctccctactccaagccctcggcttctcatccgctgaacgatgtcctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagaggtgagtgcctccgcagccccgccgcccgccgtggggtcggggacagggagaagggagtgcctgcctggtctgcgccccccgcctgtcagcccttgcctcgaggctctggggcacccaactcgtcgactcctgacaccgcagcggggtaggctgctggacagccccgagcgcctgcagctgctgctgccatctctgatctacatgcttccagctctgccagtggcagcccccctgctgctcgcagtctgatcagcaacccctcgggtcctcgcatcttccctgctgcgcgctcctgtcccagcgcggccgccgagatttccgaccttgtcccaggcagggcggtagcgttccggatcagtccttgcctccgtgcccccacgcacaggcagctccaggagcagcggccagcaacccttctggggacaccttactgtagtccggcaggacagccgatcagagccgctctagggggtggtcggagtgcccatttcggctggaatcccaactcggctccttgctctgtgaccttggggtagttagttgacttctctgaacctcgggttcctcatcggtgtaatgagcaaaacataaacaatctttttctcacagttgaggttatccacaggaagcatttaggagaactggctcaggtagacatcagtaactattagctggaattcggttaccactattgcattccttcctagcactgccaggggcctgggaattccctctcccaggtatttccatatcctgtcaggtattcccccacctattggaatagctctgcctacatggttctaataggaccaagagattggcgtcaagtccaaggggcaccattattatctgcattacttagattgcagatgatgacagtaagatcagggaacagtgttacccttagacccacccacagtattaccagtgcctatgttgctatggctaactttgctatttataacagcatcatccacatttcagattctatacgagagggatctgcaactgctcggctggtgtcattgctaatagtattattagttttgcttccaataaaaaggactatttatatgatgattgcaattacttctacaggccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggctgccggctgatgggcattcagcatggaggtggtgggtgttgttagatgtgtgtacacacgtgcatgcctacacacacacacacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggagaggtgtggcctgctctggaggaagagaagaggaagtggagatgagtggtgtgtgggatagagaaggccacagaaccctggacccctgggttccgaggctggtaccggatgtggggaagtctgagtttcctcagggctcctagctgcaattgggaggctgaggcccgagactggagagacagagctctctcagaactgcacggggctaccctcttggcctcactggtcagtgactcccatttttggggtcaagggtaggttgccctccatgttccagagcagttaggtcctcattggccttaggccctcttccctcactctcccactgtcagacagaggtgaaagggtggtccagggtgttggccccaaaatgactccaactatatgggtctctgggctgcccgtcagagagatgggagccaggtctgtgagcagctccagctccagcccagagagaagggagggagggcaccagaagggggccaggcccaggcctggcacagctcagatgcatggcaaacagtcttcccagcacccggtgggcactggctgctcctgcccaatggtccccactccagccccagaacagtcctcccaagcaccccaatgtctggagctggtctccgcacctctaatctggccccatcaagaacctcctccctctgaaaggtcagagagaggccctaagcatctggttgtgccactcctctcccaactctgaccctagggaatgatatccagacacagtgggggagatgggggttatgatggcagggaggtgggaggatctgggaaaagtaggaaatttcccatcatctcaggcttaggaaagtgcagggacaggtatgaaggcagatgctgagagggcagggaagatgggggataaacagtgggcctggaatgggagtgcacagccagtggaataaacctgatctctaggaagtcctgcctgtagtctaaccttcaattctcttgctgcatcattggcctattccatggcatacctggatctccatgctcttctaagtttagcccaacccttaaagatgatgtagctctgagtcttctctcctgggagcacattgccctcgtgcctgacttggctttactagggatccagggtcagccctatccttctctgagcctcagtctccatttctcaatgtcacaacacatcctttttatgagagtgtaagtgcttcgagatctttggaggaatattctgggttctagagcttctgatagccaggggtaggaaggggtagcccctcccatttattctccccccccttagtccaccctccagcccaaggctttcacaaaaggtagggtgggggaagggaggggctggatagaggccagactggcagagacaggggctttgtcccaactgatttctgagccaagagttc

SEQ ID NO: 304988 - DNA, 1010 bp, Homo sapiens
tcggacatatgtcgaccacggcgtctgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304989 - DNA, 5198 bp, Homo sapiens
gagttcctggctgggcagcactcaaggcccaccccctggcatcaggctgcacattcagcatcgacagccctggccagtaggccttctgggctcccagcaacgcctgcattttccacattggtttgcatgactggtaatgtcccttcacagggccaccctcaccccacccccaccccaggtctagagatttcctgaattgctttgcttaacccatgattctgctgtctaacctccatccttccagctgcaaagtcagctcctcctctgtgcagggagtgggagcaccacaggagccaatgcccaatcatagctgcctccagggaggtagctacggtcctttgcaccccattctgcctccagaatatgagttttccattttttttattagaaagggtgtctcttttcaggagcaaagcccccattctcccttcatccacttcttacagtctaattgactccctcctccttcttctttgaacaacgagaagactctccagttgtccaacttccacccctccagctgcaacatcgtcatcctttagctcagcgaacgctgggcgaacgctccctccccgcccctcctgcccctcctccctactccaagccctcggcttctcatccgctgaacgatgtcctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagaggtgagtgcctccgcagccccgccgcccgccgtggggtcggggacagggagaagggagtgcctgcctggtctgcgccccccgcctgtcagcccttgcctcgaggctctggggcacccaactcgtcgactcctgacaccgcagcggggtaggctgctggacagccccgagcgcctgcagctgctgctgccatctctgatctacatgcttccagctctgccagtggcagcccccctgctgctcgcagtctgatcagcaacccctcgggtcctcgcatcttccctgctgcgcgctcctgtcccagcgcggccgccgagatttccgaccttgtcccaggcagggcggtagcgttccggatcagtccttgcctccgtgcccccacgcacaggcagctccaggagcagcggccagcaacccttctggggacaccttactgtagtccggcaggacagccgatcagagccgctctagggggtggtcggagtgcccatttcggctggaatcccaactcggctccttgctctgtgaccttggggtagttagttgacttctctgaacctcgggttcctcatcggtgtaatgagcaaaacataaacaatctttttctcacagttgaggttatccacaggaagcatttaggagaactggctcaggtagacatcagtaactattagctggaattcggttaccactattgcattccttcctagcactgccaggggcctgggaattccctctcccaggtatttccatatcctgtcaggtattcccccacctattggaatagctctgcctacatggttctaataggaccaagagattggcgtcaagtccaaggggcaccattattatctgcattacttagattgcagatgatgacagtaagatcagggaacagtgttacccttagacccacccacagtattaccagtgcctatgttgctatggctaactttgctatttataacagcatcatccacatttcagattctatacgagagggatctgcaactgctcggctggtgtcattgctaatagtattattagttttgcttccaataaaaaggactatttatatgatgattgcaattacttctacaggccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggctgccggctgatgggcattcagcatggaggtggtgggtgttgttagatgtgtgtacacacgtgcatgcctacacacacacacacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcaggtaagcaaccccacttggggtcaccgtctctgtcttgttcagccctaaccaactgcttccaggcttaggggccccaggaagagagagaattggagggctgtggggaagcgtccaggctggaacacttggaaataagggctgagctgtgagcatctggtgggttggagaaatcatggggcaggactagggaagggcactgggtgcaaggctttgggcccctaaggtggaggataggggatcctgaagctaggaggtgggaaaggggtggaactgggagaaaccctgaaggaggccctaaagggagcagactgggaaactgggctggaggactcagggggcgaggttggaggaccctggggtgtggtctaggaattttggagaggaagtggaagactctgagagcagggcaaggaatcctgggggctgaattgactgggagactttgggggatgggtctggagaccgtcggggtggtcctggaggacctagaggtagggctgcaggaccctggcccctggcccctggcccctggtcctaggggggccggggaatcctggggccggaaggagggatcctggagcggggcttggaggccaccgggtgggactctgagggtcgacagcgttaagttccagccggctccacccgttcacagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304990 - DNA, 5302 bp, Homo sapiens
gagttcctggctgggcagcactcaaggcccaccccctggcatcaggctgcacattcagcatcgacagccctggccagtaggccttctgggctcccagcaacgcctgcattttccacattggtttgcatgactggtaatgtcccttcacagggccaccctcaccccacccccaccccaggtctagagatttcctgaattgctttgcttaacccatgattctgctgtctaacctccatccttccagctgcaaagtcagctcctcctctgtgcagggagtgggagcaccacaggagccaatgcccaatcatagctgcctccagggaggtagctacggtcctttgcaccccattctgcctccagaatatgagttttccattttttttattagaaagggtgtctcttttcaggagcaaagcccccattctcccttcatccacttcttacagtctaattgactccctcctccttcttctttgaacaacgagaagactctccagttgtccaacttccacccctccagctgcaacatcgtcatcctttagctcagcgaacgctgggcgaacgctccctccccgcccctcctgcccctcctccctactccaagccctcggcttctcatccgctgaacgatgtcctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagaggtgagtgcctccgcagccccgccgcccgccgtggggtcggggacagggagaagggagtgcctgcctggtctgcgccccccgcctgtcagcccttgcctcgaggctctggggcacccaactcgtcgactcctgacaccgcagcggggtaggctgctggacagccccgagcgcctgcagctgctgctgccatctctgatctacatgcttccagctctgccagtggcagcccccctgctgctcgcagtctgatcagcaacccctcgggtcctcgcatcttccctgctgcgcgctcctgtcccagcgcggccgccgagatttccgaccttgtcccaggcagggcggtagcgttccggatcagtccttgcctccgtgcccccacgcacaggcagctccaggagcagcggccagcaacccttctggggacaccttactgtagtccggcaggacagccgatcagagccgctctagggggtggtcggagtgcccatttcggctggaatcccaactcggctccttgctctgtgaccttggggtagttagttgacttctctgaacctcgggttcctcatcggtgtaatgagcaaaacataaacaatctttttctcacagttgaggttatccacaggaagcatttaggagaactggctcaggtagacatcagtaactattagctggaattcggttaccactattgcattccttcctagcactgccaggggcctgggaattccctctcccaggtatttccatatcctgtcaggtattcccccacctattggaatagctctgcctacatggttctaataggaccaagagattggcgtcaagtccaaggggcaccattattatctgcattacttagattgcagatgatgacagtaagatcagggaacagtgttacccttagacccacccacagtattaccagtgcctatgttgctatggctaactttgctatttataacagcatcatccacatttcagattctatacgagagggatctgcaactgctcggctggtgtcattgctaatagtattattagttttgcttccaataaaaaggactatttatatgatgattgcaattacttctacaggccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggctgccggctgatgggcattcagcatggaggtggtgggtgttgttagatgtgtgtacacacgtgcatgcctacacacacacacacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcaggtaagcaaccccacttggggtcaccgtctctgtcttgttcagccctaaccaactgcttccaggcttaggggccccaggaagagagagaattggagggctgtggggaagcgtccaggctggaacacttggaaataagggctgagctgtgagcatctggtgggttggagaaatcatggggcaggactagggaagggcactgggtgcaaggctttgggcccctaaggtggaggataggggatcctgaagctaggaggtgggaaaggggtggaactgggagaaaccctgaaggaggccctaaagggagcagactgggaaactgggctggaggactcagggggcgaggttggaggaccctggggtgtggtctaggaattttggagaggaagtggaagactctgagagcagggcaaggaatcctgggggctgaattgactgggagactttgggggatgggtctggagaccgtcggggtggtcctggaggacctagaggtagggctgcaggaccctggcccctggcccctggcccctggtcctaggggggccggggaatcctggggccggaaggagggatcctggagcggggcttggaggccaccgggtgggactctgagggtcgacagcgttaagttccagccggctccacccgttcacagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaacca

SEQ ID NO: 304991 - DNA, 859 bp, Homo sapiens
gacaatggagtgacgtgccctgcaactaccatgaccacgcagttctctcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304992 - DNA, 818 bp, Homo sapiens
gttacttgtgataccgccctgatatgttggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304993 - DNA, 742 bp, Homo sapiens
gatcgctggtgtgtcatgcactacactgtctacactgcagatggggctgtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 304994 - DNA, 709 bp, Homo sapiens
  misc_feature (32)..(33): n is a, c, g, or t
ctgtcggccggaagtattggattgtcgacccnncgtcgcgtctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaagggggtcgctttcttctagcggagaagggggctcctgggccccgcttattgcctttatcctccttttacttcgg

SEQ ID NO: 304995 - DNA, 338 bp, Homo sapiens
ccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctggtgagaggccccagtcgaaccccgccgtctagctcacttcctctaagcacttctgttccctaccacccccac

SEQ ID NO: 304996 - DNA, 477 bp, Homo sapiens
ggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgaggtgagcccacctccctgcagaagctgagaccaatctcagaaaggcagagttgagtcctaaaagtcctaccccagtctgatcagtttagctcagggctttgccatttgcctgaagtggtcgtgggtgaagtccagcttgtcatctagggttctaattctgggcatgccctctggtgtggtgtctgtcagctgtttggcccaaggagtagtcaccttttggcctctccttatctgccttcccaccagtagtccatgccttgtttgctccagctgggctgctgaataagctcccatct

SEQ ID NO: 304997 - DNA, 289 bp, Homo sapiens
cagatgagggaactggagaagcttgcccagggttcccatgggagaccagagtggaaggagctaccagctgcctgataacccagccttctcttctccacccaggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccag

SEQ ID NO: 304998 - DNA, 1773 bp, Homo sapiens
gcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgatggaggcctttgagcaggccgagcggaagcccaaacccaaccccaacctgctcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctcta

SEQ ID NO: 304999 - DNA, 2076 bp, Homo sapiens
gcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgatggaggcctttgagcaggccgagcggaagcccaaacccaaccccaacctgctcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctctaaaaaaaaaaaaacaaaaaagaaaacaaaagaacaagaaggggacacccagaaaatcccagaagaggcccaagatcagataccaagattgctacaaggggcaccaaagagaacacataaaaagagcgacgacagacacgcatataaagacacgataaggcacaacgcaacacaggaacactggaagcaccacaaaaccggaaggagagaagaataggacacaccacacggagtcaacgacagggaaataacatgagctgactgcgcaccacgactctgacccaaaacgatcgagataatcacaa

SEQ ID NO: 305000 - DNA, 1709 bp, Homo sapiens
gcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctcta

SEQ ID NO: 305001 - DNA, 1718 bp, Homo sapiens
gcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgatggaggcctttgagcaggccgagcggaagcccaaacccaaccccaacctgctcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctcccttgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctcta

SEQ ID NO: 305002 - DNA, 1342 bp, Homo sapiens
gcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaagggtgagggcacattcaggactagaagcccctctgggcatggggtggacatggcaggtcagcctgtggaacttgcgcaggtgcgagtggccagcagaggtcacgaataaactgcatctctgcgcctggctctcta

SEQ ID NO: 305003 - DNA, 1878 bp, Homo sapiens
gcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacgtgagaggcggctcccccacttcccgtgccccccacgcccaggccccttgcctgtctcctctctggtcccaactgccccacgtctatctgtgcctccacccgcagctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgatggaggcctttgagcaggccgagcggaagcccaaacccaaccccaacctgctcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctcta

SEQ ID NO: 305004 - DNA, 1866 bp, Homo sapiens
gcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcagaagcgaggcctcaccatgttgctcaggctggtctccaactcctgggctcaagcgatcctccaacgtcagcctctcaaagtgctgggattacaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgatggaggcctttgagcaggccgagcggaagcccaaacccaaccccaacctgctcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctcta

SEQ ID NO: 305005 - DNA, 1361 bp, Homo sapiens
ctccacatgggagagctggccgcctctgcaagaatgactgtccagcactgagggtcagcagaagtgtctgggcagctgcaaatgggactcatgcagaggcagcatggtgcagggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgatggaggcctttgagcaggccgagcggaagcccaaacccaaccccaacctgctcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctcta

SEQ ID NO: 305006 - DNA, 748 bp, Homo sapiens
tagcacctgatccctgctgggatttgagggttttcattacacttctgctaggataatcatttccattgtcgaggtgggaacacaaaggcttggagtggttaattccttgccaaggccccgcaggaggaagcagggtcctgcatgggaggccggctagcctgcccactgccccatgtccccacagtgatggaggcctttgagcaggccgagcggaagcccaaacccaaccccaacctgctcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctcta

SEQ ID NO: 305007 - DNA, 629 bp, Homo sapiens
tcataggttcgcaggaaggtgatggaggcctttgagcaggccgagcggaagcagtcccgcaggagtgatggaggcctttgagcaggccgagcggaagcccaaacccaaccccaacctgctcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctcta

SEQ ID NO: 305008 - DNA, 1781 bp, Homo sapiens
gcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgatggaggcctttgagcaggccgagcggaagcccaaacccaaccccaacctgctcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtgatactcgggtcacgaataactgatccgccagcgggccggcggccggccggcggga

SEQ ID NO: 305009 - DNA, 1408 bp, Homo sapiens
  misc_feature (1231)..(1231): n is a, c, g, or t
gcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaagagatggatatagacgcttttcancacgccgagcaggaccacaacacaaccacaaactattcttatacagacgttatgaggaaatccccaacttcttacggagcaggaggaatttgtggcccactcctgcctacttcgggcagtaccactggttgaatactttaattagacacactggtccacccaccccatccttgttac

SEQ ID NO: 305010 - DNA, 1637 bp, Homo sapiens
caccgcagccaggttctcattgctcctgtgcactggacgatgctcgctcagctacccagtgggcccatcggcgagagtcctgatatgagttagttggcattctatcgcatggcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgatggaggcctttgagcaggccgagcggaagcccaaacccaaccccaacctgctcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctcta

SEQ ID NO: 305011 - DNA, 1751 bp, Homo sapiens
gcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgatggaggcctttgagcaggccgagcggaagcccaaacccaaccccaacctgctcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctcta

SEQ ID NO: 305012 - DNA, 850 bp, Homo sapiens
gcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagtcacctgttgttacagtgccttctcccaggggctgggtgagggcacattcaggactagaagcccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctcta

SEQ ID NO: 305013 - DNA, 3824 bp, Homo sapiens
agcggacggcagccgaaggggccattccgtgtgcagcgctcccgcccaccctccggtctcggcggctctccagagcgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatgtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttatgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaacagctggagcatttccttccctttccagtgaaggagcagcatagtgaaatcctggcacccctcacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttctattatatctaaattagaatgatcatcctgcgcaaattcagattactgtttgctggctaattgacagtatttctcagcatcactatgtagcattctgttttagcatctttgaattatgatcatttgatttggctaattacaaaaagtacaggtttaaactggacttaccttgagttaaaggcaaagaaaatctaaaaacataaatgttatatttcacaagaaatcagttgcatattatccattacatatttagttttaaaaggaggagtcaccttgaattattttctgagtcaccttgagttatttgatctctcagcctgctttctcatctgtaaaaaaggggggaggataactttcacagggtaattggtaggctaaataggagttacagaaaactgttaaatagggaagaactacattaaatttaaatattcacatta

SEQ ID NO: 305014 - DNA, 3913 bp, Homo sapiens
agcggacggcagccgaaggggccattccgtgtgcagcgctcccgcccaccctccggtctcggcggctctccagagcgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatgtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttatgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaacagctggagcatttccttccctttccagtgaaggagcagcatagtgaaatcctggcacccctcacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttctattatatctaaattagaatgatcatcctgcgcaaattcagattactgtttgctggctaattgacagtatttctcagcatcactatgtagcattctgttttagcatctttgaattatgatcatttgatttggctaattacaaaaagtacaggtttaaactggacttaccttgagttaaaggcaaagaaaatctaaaaacataaatgttatatttcacaagaaatcagttgcatattatccattacatatttagttttaaaaggaggagtcaccttgaattattttctgagtcaccttgagttatttgatctctcagcctgctttctcatctgtaaaaaaggggggaggataactttcacagggtaattggtaggctaaataggagttacagaaaactgttaaatagggaagaactacattaaatttaaatattcacattatgcctgtgtttgactattgttagcatttaagtcactaaagatcaatatatttaatgagttggactctaaatatgtggtactgtaggtat

SEQ ID NO: 305015 - DNA, 3770 bp, Homo sapiens
agcggacggcagccgaaggggccattccgtgtgcagcgctcccgcccaccctccggtctcggcggctctccagagcgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatgtacaagcagtggtgcatggcaatggaccaaggacagcagaactcaagcaggcataccaaggctgggaagacagatgctaatagcaattcctggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttatgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaacagctggagcatttccttccctttccagtgaaggagcagcatagtgaaatcctggcacccctcacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttctattatatctaaattagaatgatcatcctgcgcaaattcagattactgtttgctggctaattgacagtatttctcagcatcactatgtagcattctgttttagcatctttgaattatgatcatttgatttggctaattacaaaaagtacaggtttaaactggacttaccttgagttaaaggcaaagaaaatctaaaaacataaatgttatatttcacaagaaatcagttgcatattatccattacatatttagttttaaaaggaggagtcaccttgaattattttctgagtcaccttgagttatttgatctctcagcctgctttctcatctgtaaaaaaggggggaggataactttcacagggtaattggtaggctaaataggagttacagaaaactgttaaatagggaagaactacattaaatttaaatattcacatta

SEQ ID NO: 305016 - DNA, 3927 bp, Homo sapiens
agcggacggcagccgaaggggccattccgtgtgcagcgctcccgcccaccctccggtctcggcggctctccagagcgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtttgtttcaaaaatcagtgaagtccatgaagtacactgtgttctctttctggcgtctcaaaagcagctactcctgaattaattaaaaagagcaatatatgaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatgtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttatgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaacagctggagcatttccttccctttccagtgaaggagcagcatagtgaaatcctggcacccctcacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttctattatatctaaattagaatgatcatcctgcgcaaattcagattactgtttgctggctaattgacagtatttctcagcatcactatgtagcattctgttttagcatctttgaattatgatcatttgatttggctaattacaaaaagtacaggtttaaactggacttaccttgagttaaaggcaaagaaaatctaaaaacataaatgttatatttcacaagaaatcagttgcatattatccattacatatttagttttaaaaggaggagtcaccttgaattattttctgagtcaccttgagttatttgatctctcagcctgctttctcatctgtaaaaaaggggggaggataactttcacagggtaattggtaggctaaataggagttacagaaaactgttaaatagggaagaactacattaaatttaaatattcacatta

SEQ ID NO: 305017 - DNA, 3029 bp, Homo sapiens
agcggacggcagccgaaggggccattccgtgtgcagcgctcccgcccaccctccggtctcggcggctctccagagcgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatgtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttatgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgatta

SEQ ID NO: 305018 - DNA, 3770 bp, Homo sapiens
agcggacggcagccgaaggggccattccgtgtgcagcgctcccgcccaccctccggtctcggcggctctccagagcgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatgtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttatgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaacagctggagcatttccttccctttccagtgaaggagcagcatagtgaaatcctggcacccctcacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttctattatatctaaattagaatgatcatcctgcgcaaattcagattactgtttgctggctaattgacagtatttctcagcatcactatgtagcattctgttttagcatctttgaattatgatcatttgatttggctaattacaaaaagtacaggtttaaactggacttaccttgagttaaaggcaaagaaaatctaaaaacataaatgttatatttcacaagaaatcagttgcatattatccattacatatttagttttaaaaggaggagtcaccttgaattattttctgagtcaccttgagttatttgatctctcagcctgctttctcatctgtaaaaaaggggggaggataactttcacagggtaattggtaggctaaataggagttacagaaaactgttaaatagggaagaactacattaaatttaaatattcacatta

SEQ ID NO: 305019 - DNA, 477 bp, Homo sapiens
ccacgcccatctagaacaaacttcttatgttttcagtattttttacaaaattgaagaaatcggctttttgataacttttattagataacatttgtcttcatctaggttgacaagtgcactaaaatatcagactccaccactatacaattcacccacgtaaccaaaaaccacttctaccccaaaagctactgaaatgtttaaaaattaaaacatttggcttcatctaaattaaattaatggaaaaaagccaaatcagcttttttttagtctgtatttttaaaaattagccttactgaagatactaaactgaaaaaaaaaatttatgcatcttaaaacagattaatcaaactttattgactctaaaaacattcttacattggtaacttttatttttcagggtgaagattatataaagatgagtcagtgattgaagccaatattctgattcccatggaagatggatgggcaagagtgtac

SEQ ID NO: 305020 - DNA, 549 bp, Homo sapiens
  misc_feature (57)..(57): n is a, c, g, or t
gaggaccggcccccctcgagtcgacgttatcgttagctgatatcaattcgcgccgcncgatacggttgcgagagacgacagaaggggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcattt

SEQ ID NO: 305021 - DNA, 2070 bp, Homo sapiens
  misc_feature (325)..(325): n is a, c, g, or t
  misc_feature (833)..(833): n is a, c, g, or t
  misc_feature (1256)..(1256): n is a, c, g, or t
  misc_feature (1336)..(1336): n is a, c, g, or t
ttaggatctttttcttttaactactttttttttggtgtcgtatacaaacagcctctggttctaattactttttctaataagtcaagcagaatgcttgattaaagttttttccatttactattccacagtttaatatagatcttagttattttcttttcccatttaggacacgtgttttagtaatatagactgcatgcattgatccctttagaaattttactgatgatttatatttatagccacagatgtctatattcaaacaaagtttatttttctatgataaaaataatacaagtgtcctaaagaaaatttggaatatataggnaaaagaagaaaaaaaaaaaaaaaaaaaaaagaaaatagatgactgcttgaagaatttagtaagagaactttaagctatagaaaaagagttgaatggacataactagaaaatgtaacaactgaaattagaatttaatagatggcttttaaaggaggttaacatggctgaagagaagattagtgaattggaagatagaacaatagatgttatcaagactacttcatctgatgagtcatagtgaaaaattagaatacatacaaggaaatccaatgagaaattacacatgcaataatagatggaagaatcatagacatgataattggaaagaggctttaaaataaacatacatatttaaagagatgcaaaaaaggaatattattaagacaataggatatgaggagaaaaacaggtagatttgaaaaataaccaaataatattttctagaaacaaaaattacaatctgtgaaataaaaagtcaacagatatagtgacccagtcgatgttttcncgcaatatgtcaaatacagctgaagagagaattagtgaattggagataggtctgaggaaatccccaggatatagtactttgattagattgtgttaatcgaaaatgtctgattaactttggtatcaggtttaaactttactcaaaaatttaaaaacataattatagcctgatatttgatgacttatggaaatgatgcatctcttaatattttatgaagttgatactttggataattggatattattggacttcataaacattaatagaacagcacgtagaacagagtctcgcacattatagatactcaatatttgttgaatgagtggaatgaatgaatgaaatgtaagaataaaatcatagctacaaccttttgatttcagaatggggcagaggctgctcggattcacatatctgatactaagntcctatttttcattttaatttatggatatttattttagaggtcaacccaataatctagcaaaatatcactattaatatgncttgcttaagaaatattggcttctgaataactacagatacacatgtataaatgaggtagttttttagatgtctatatatagatataattatctatatatcaaattatatctctagctaaattagttaattttcctccatggttctgggagaattgaacaaaggtattgtgctaagtttacattcaaaggcagcttgcacattttagacttgtcagtattaagaatgtggtgaggttttaaattgtagatctatttataagagatttatagcagttactataaaggatattattagaaagcaggtatgagctattaacaaatgaattttacttattttgcttaaaacaaaaagtgaaggacacaacccaaatttaaaatttaaaattattcttaacttctaaagttttttttatcattgatttcctaagtgttgtagtaggtgaattttgttggtgataaactggtgattcaattctctgcacttgctcttttctctgagcaggtgcgggcattctatgtgaacgtgctgaatgaggaacagaggaaacgtctgtgtgagaacattgccggccacctgaaggatgcacaaattttcatccagaagaaagcggtgagtctttgtaagctgaagggtgtcctctgctggctaaggaagacagtgcagctgtgtgggagaaccctaaaaagaaagtgccatttctgttttacttgacttaagagaacttaaaaaaaaa

SEQ ID NO: 305022 - DNA, 506 bp, Homo sapiens
gtgtgcgttgtgtttatatctgtgtatgtgtacgtgtgtatttgattaccacttgaatttatttctcatcacagtgattatttgcagacttacttgacttttcttattcctaagtgcatctgggtggttttgttttgaaggtggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtgagtctttgtaagctgaagggtgtcctctgctggctaaggaagacagtgcagctgtgtgggagaaccctaaaaagaaagtgccatttctgttttacttgacttaagagaacttaaaaaaaaa

SEQ ID NO: 305023 - DNA, 774 bp, Homo sapiens
  misc_feature (325)..(325): n is a, c, g, or t
ttaggatctttttcttttaactactttttttttggtgtcgtatacaaacagcctctggttctaattactttttctaataagtcaagcagaatgcttgattaaagttttttccatttactattccacagtttaatatagatcttagttattttcttttcccatttaggacacgtgttttagtaatatagactgcatgcattgatccctttagaaattttactgatgatttatatttatagccacagatgtctatattcaaacaaagtttatttttctatgataaaaataatacaagtgtcctaaagaaaatttggaatatataggnaaaagaagaaaaaagaaaaattcccatatagtcccaacacccaaaggtcatagctattacattttgctatatttatttatctatttatttattttttagacagagtctcactctgttgcccaggctggagtgcagtgcatgatcttggctcactgcagcctctgcctctgggttcaagagattctcatgcctcagcctcccgagtagctggaagtataggagtgtgccaccacgccagctaatttttgtatttttagtagagacagggtttcattggccaggctggtcctgaactcttgacctcaggtgacccacccactttggccccccaaagtgctgagattacaggcatgagccaccgcgcctggcttgattgtaaaagtagagcatttgggctgtgaccctgaagctcagtgaaagagcttaattgttcctgtggtcagtgcttt

SEQ ID NO: 305024 - DNA, 2344 bp, Homo sapiens
  misc_feature (25)..(25): n is a, c, g, or t
acagaagatagttactaatcgtgcngtcgctcgggttactcagtctcggggcctgggcgtcatgatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaa

SEQ ID NO: 305025 - DNA, 2338 bp, Homo sapiens
agggggtggtgctgattggctgagcctgaagtcgccacggactcggggcaacaggcagatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaa

SEQ ID NO: 305026 - DNA, 2443 bp, Homo sapiens
  misc_feature (25)..(25): n is a, c, g, or t
  misc_feature (2368)..(2368): n is a, c, g, or t
acagaagatagttactaatcgtgcngtcgctcgggttactcagtctcggggcctgggcgtcatgatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaaacaaaaaaacaacaaaaaacaccncaccacacaccaaccacaatccaacacacaaacacagaatcgaacaaccaccccccaagcaaaacctccccacac

SEQ ID NO: 305027 - DNA, 2288 bp, Homo sapiens
  misc_feature (25)..(25): n is a, c, g, or t
acagaagatagttactaatcgtgcngtcgctcgggttactcagtctcggggcctgggcgtcatgatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtccatcttttatccacagccggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaa

SEQ ID NO: 305028 - DNA, 2302 bp, Homo sapiens
  misc_feature (25)..(25): n is a, c, g, or t
acagaagatagttactaatcgtgcngtcgctcgggttactcagtctcggggcctgggcgtcatgatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaa

SEQ ID NO: 305029 - DNA, 2286 bp, Homo sapiens
  misc_feature (25)..(25): n is a, c, g, or t
acagaagatagttactaatcgtgcngtcgctcgggttactcagtctcggggcctgggcgtcatgatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaa

SEQ ID NO: 305030 - DNA, 2287 bp, Homo sapiens
  misc_feature (25)..(25): n is a, c, g, or t
acagaagatagttactaatcgtgcngtcgctcgggttactcagtctcggggcctgggcgtcatgatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggccgcctttttgcctatcctgacactcaccgccatcgcctgggacccaattatcttcatatacctgtgaactgtccctaccgtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaa

SEQ ID NO: 305031 - DNA, 2300 bp, Homo sapiens
  misc_feature (25)..(25): n is a, c, g, or t
acagaagatagttactaatcgtgcngtcgctcgggttactcagtctcggggcctgggcgtcatgatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggcaccgtcatggcttaatgtttattcctgataataattgatcaaattcatttttttcactggagttacattaatgttaattcagcactgatttcacaacagatcaatttgtaattgcttacatttttacaataaataatctgtacgtaagaa

SEQ ID NO: 305032 - DNA, 1936 bp, Homo sapiens
tttctgatcttgctttgttgcccaggctggattgcagtgacacgattgcagctcactgctgcctcaatcccctgggccaagcagtcctcccacttcagcctgttggagtagctgggactacaggcacatgccaccatgctcggctaatgttttaatttttttttttgtagagacaggtctcgctgtgttgcccaggctggtctcaaactccctgggcccaagcgatcctctcaccttggccttccagagtgctgggattataataggcatgggccactgtgcccagttggaagtgcttatttgaagaatttcccatgctgttggttttgtagaaatgtgttgctttttgtaaagagcaaatgattggttccttccctggagtgggggaatgaggaggaatagaattaattcaatatttcagttagttaacgttctagcacatttattttataatgcaatacttccttgggaataggaagtaatactgtataagacaagacactaacttgttatgcagaaggaaaaaaaaaagatattattaccaaaaacagatgtgaagatttatggttggccagagggcttgggaaattcagaactgttcagttagggagaactcgtttcataagagtagaggcttcactcttaagtagcgggaaaggcagaattttgtggtaaccatgtacagagtgctttgtacttcaaatttcagaatgaagtttacagcccattcctatgttatatgttactgcccctagtcagtgtctattgtatttattactgcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaa

SEQ ID NO: 305033 - DNA, 1882 bp, Homo sapiens
tttctgatcttgctttgttgcccaggctggattgcagtgacacgattgcagctcactgctgcctcaatcccctgggccaagcagtcctcccacttcagcctgttggagtagctgggactacaggcacatgccaccatgctcggctaatgttttaatttttttttttgtagagacaggtctcgctgtgttgcccaggctggtctcaaactccctgggcccaagcgatcctctcaccttggccttccagagtgctgggattataataggcatgggccactgtgcccagttggaagtgcttatttgaagaatttcccatgctgttggttttgtagaaatgtgttgctttttgtaaagagcaaatgattggttccttccctggagtgggggaatgaggaggaatagaattaattcaatatttcagttagttaacgttctagcacatttattttataatgcaatacttccttgggaataggaagtaatactgtataagacaagacactaacttgttatgcagaaggaaaaaaaaaagatattattaccattcagttagggagaactcgtttcataagagtagaggcttcactcttaagtagcgggaaaggcagaattttgtggtaaccatgtacagagtgctttgtacttcaaatttcagaatgaagtttacagcccattcctatgttatatgttactgcccctagtcagtgtctattgtatttattactgcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaa

SEQ ID NO: 305034 - DNA, 1845 bp, Homo sapiens
tttctgatcttgctttgttgcccaggctggattgcagtgacacgattgcagctcactgctgcctcaatcccctgggccaagcagtcctcccacttcagcctgttggagtagctgggactacaggcacatgccaccatgctcggctaatgttttaatttttttttttgtagagacaggtctcgctgtgttgcccaggctggtctcaaactccctgggcccaagcgatcctctcaccttggccttccagagtgctgggattataataggcatgggccactgtgcccagttggaagtgcttatttgaagaatttcccatgctgttggttttgtagaaatgtgttgctttttgtaaagagcaaatgattggttcttccttgggaataggaagtaatactgtataagacaagacactaacttgttatgcagaaggaaaaaaaaaagatattattaccaaaaacagatgtgaagatttatggttggccagagggcttgggaaattcagaactgttcagttagggagaactcgtttcataagagtagaggcttcactcttaagtagcgggaaaggcagaattttgtggtaaccatgtacagagtgctttgtacttcaaatttcagaatgaagtttacagcccattcctatgttatatgttactgcccctagtcagtgtctattgtatttattactgcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaa

SEQ ID NO: 305035 - DNA, 1924 bp, Homo sapiens
  misc_feature (25)..(25): n is a, c, g, or t
acagaagatagttactaatcgtgcngtcgctcgggttactcagtctcggggcctgggcgtcatgatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcattt

SEQ ID NO: 305036 - DNA, 2286 bp, Homo sapiens
  misc_feature (25)..(25): n is a, c, g, or t
acagaagatagttactaatcgtgcngtcgctcgggttactcagtctcggggcctgggcgtcatgatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaa

SEQ ID NO: 305037 - DNA, 1110 bp, Homo sapiens
gaaaagtgtgccaaatgcatacgaatggaaaaaaactaccgtgtagcggacgacgagtactgtaagtcataggttcatatcgtggctcctgtgtgcgtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaa

SEQ ID NO: 305038 - DNA, 2721 bp, Homo sapiens
  misc_feature (325)..(325): n is a, c, g, or t
  misc_feature (833)..(833): n is a, c, g, or t
  misc_feature (1256)..(1256): n is a, c, g, or t
  misc_feature (1336)..(1336): n is a, c, g, or t
ttaggatctttttcttttaactactttttttttggtgtcgtatacaaacagcctctggttctaattactttttctaataagtcaagcagaatgcttgattaaagttttttccatttactattccacagtttaatatagatcttagttattttcttttcccatttaggacacgtgttttagtaatatagactgcatgcattgatccctttagaaattttactgatgatttatatttatagccacagatgtctatattcaaacaaagtttatttttctatgataaaaataatacaagtgtcctaaagaaaatttggaatatataggnaaaagaagaaaaaaaaaaaaaaaaaaaaaagaaaatagatgactgcttgaagaatttagtaagagaactttaagctatagaaaaagagttgaatggacataactagaaaatgtaacaactgaaattagaatttaatagatggcttttaaaggaggttaacatggctgaagagaagattagtgaattggaagatagaacaatagatgttatcaagactacttcatctgatgagtcatagtgaaaaattagaatacatacaaggaaatccaatgagaaattacacatgcaataatagatggaagaatcatagacatgataattggaaagaggctttaaaataaacatacatatttaaagagatgcaaaaaaggaatattattaagacaataggatatgaggagaaaaacaggtagatttgaaaaataaccaaataatattttctagaaacaaaaattacaatctgtgaaataaaaagtcaacagatatagtgacccagtcgatgttttcncgcaatatgtcaaatacagctgaagagagaattagtgaattggagataggtctgaggaaatccccaggatatagtactttgattagattgtgttaatcgaaaatgtctgattaactttggtatcaggtttaaactttactcaaaaatttaaaaacataattatagcctgatatttgatgacttatggaaatgatgcatctcttaatattttatgaagttgatactttggataattggatattattggacttcataaacattaatagaacagcacgtagaacagagtctcgcacattatagatactcaatatttgttgaatgagtggaatgaatgaatgaaatgtaagaataaaatcatagctacaaccttttgatttcagaatggggcagaggctgctcggattcacatatctgatactaagntcctatttttcattttaatttatggatatttattttagaggtcaacccaataatctagcaaaatatcactattaatatgncttgcttaagaaatattggcttctgaataactacagatacacatgtataaatgaggtagttttttagatgtctatatatagatataattatctatatatcaaattatatctctagctaaattagttaattttcctccatggttctgggagaattgaacaaaggtattgtgctaagtttacattcaaaggcagcttgcacattttagacttgtcagtattaagaatgtggtgaggttttaaattgtagatctatttataagagatttatagcagttactataaaggatattattagaaagcaggtatgagctattaacaaatgaattttacttattttgcttaaaacaaaaagtgaaggacacaacccaaatttaaaatttaaaattattcttaacttctaaagttttttttatcattgatttcctaagtgttgtagtaggtgaattttgttggtgataaactggtgattcaattctctgcacttgctcttttctctgagcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaa

SEQ ID NO: 305039 - DNA, 1134 bp, Homo sapiens
tatataaaagacagtacattcgaagggttttagatctgtgtcaggaatgggggacaaagaccaaatagtatttttaaaattatactgattaggtgtcattttcttgcgcatttcggcagagggacataagctcagtaagttaagtgacctatccgaggttgctcagccagtatatgtcagagtgttcactggacctgcatcttaactctgaggctggcattgttaaacacctgtagtactgcctcctgctgaaacgtctttcctcccctatggaataaacactgggaaaccacagtccctggggagtgatatagtagggagttagagtaatgcttgcatttattttcctttggccttaggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaa

SEQ ID NO: 305040 - DNA, 1693 bp, Homo sapiens
  misc_feature (25)..(25): n is a, c, g, or t
acagaagatagttactaatcgtgcngtcgctcgggttactcagtctcggggcctgggcgtcatgatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtgagtctttgtaagctgaagggtgtcctctgctggctaaggaagacagtgcagctgtgtgggagaaccctaaaaagaaagtgccatttctgttttacttgacttaagagaacttaaaaaaaaa

SEQ ID NO: 305041 - DNA, 1454 bp, Homo sapiens
  misc_feature (25)..(25): n is a, c, g, or t
acagaagatagttactaatcgtgcngtcgctcgggttactcagtctcggggcctgggcgtcatgatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagcaggtgagcctggtggattgagatgttctgaggcaggtgtccatgtgagcatgcacacacaaaatatgcagcttggcatgatctttatgtgaggaattaacaagaacattacttaaactttaatctgggtgcttggttaccttgtgggattcactgaggtgaactattcttcaatgagcattccttgagtaaaccaagtataaacaaaagtccatggtaagatccctacatatgtgaagacaagaatacttactctcttaatt

SEQ ID NO: 305042 - DNA, 2301 bp, Homo sapiens
  misc_feature (325)..(325): n is a, c, g, or t
  misc_feature (833)..(833): n is a, c, g, or t
  misc_feature (1256)..(1256): n is a, c, g, or t
  misc_feature (1336)..(1336): n is a, c, g, or t
ttaggatctttttcttttaactactttttttttggtgtcgtatacaaacagcctctggttctaattactttttctaataagtcaagcagaatgcttgattaaagttttttccatttactattccacagtttaatatagatcttagttattttcttttcccatttaggacacgtgttttagtaatatagactgcatgcattgatccctttagaaattttactgatgatttatatttatagccacagatgtctatattcaaacaaagtttatttttctatgataaaaataatacaagtgtcctaaagaaaatttggaatatataggnaaaagaagaaaaaaaaaaaaaaaaaaaaaagaaaatagatgactgcttgaagaatttagtaagagaactttaagctatagaaaaagagttgaatggacataactagaaaatgtaacaactgaaattagaatttaatagatggcttttaaaggaggttaacatggctgaagagaagattagtgaattggaagatagaacaatagatgttatcaagactacttcatctgatgagtcatagtgaaaaattagaatacatacaaggaaatccaatgagaaattacacatgcaataatagatggaagaatcatagacatgataattggaaagaggctttaaaataaacatacatatttaaagagatgcaaaaaaggaatattattaagacaataggatatgaggagaaaaacaggtagatttgaaaaataaccaaataatattttctagaaacaaaaattacaatctgtgaaataaaaagtcaacagatatagtgacccagtcgatgttttcncgcaatatgtcaaatacagctgaagagagaattagtgaattggagataggtctgaggaaatccccaggatatagtactttgattagattgtgttaatcgaaaatgtctgattaactttggtatcaggtttaaactttactcaaaaatttaaaaacataattatagcctgatatttgatgacttatggaaatgatgcatctcttaatattttatgaagttgatactttggataattggatattattggacttcataaacattaatagaacagcacgtagaacagagtctcgcacattatagatactcaatatttgttgaatgagtggaatgaatgaatgaaatgtaagaataaaatcatagctacaaccttttgatttcagaatggggcagaggctgctcggattcacatatctgatactaagntcctatttttcattttaatttatggatatttattttagaggtcaacccaataatctagcaaaatatcactattaatatgncttgcttaagaaatattggcttctgaataactacagatacacatgtataaatgaggtagttttttagatgtctatatatagatataattatctatatatcaaattatatctctagctaaattagttaattttcctccatggttctgggagaattgaacaaaggtattgtgctaagtttacattcaaaggcagcttgcacattttagacttgtcagtattaagaatgtggtgaggttttaaattgtagatctatttataagagatttatagcagttactataaaggatattattagaaagcaggtatgagctattaacaaatgaattttacttattttgcttaaaacaaaaagtgaaggacacaacccaaatttaaaatttaaaattattcttaacttctaaagttttttttatcattgatttcctaagtgttgtagtaggtgaattttgttggtgataaactggtgattcaattctctgcacttgctcttttctctgagcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcattt

SEQ ID NO: 305043 - DNA, 702 bp, Homo sapiens
  misc_feature (25)..(25): n is a, c, g, or t
acagaagatagttactaatcgtgcngtcgctcgggttactcagtctcggggcctgggcgtcatgatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttctttgttcaaggaatgccaatattagtttccattcttctatttcaccattcagactttctggagccttaacctcctgagtcctttgaatcaaagttttattttctttgt

SEQ ID NO: 305044 - DNA, 1005 bp, Homo sapiens
tggttatgtggttgctctgtgttgttccggatgtgccatgtaccaatgatttcttttgactggcacacttgtcgttgcccgtaagctgctggcaacgcaccaacgtggagaagtaggcgcctggggtatatatgctggccctccttcaatgtccctgtcgttcgcttcgtgctcattcagtgttcctgtcacgtgtgcactcgcgcgcttgttaaccaatacccggctaccagcatgtctgagtacacacacgcagagaagccagcaggggcgggccgggcccgaccactccgcaaaccgcagggggaacttgcggcaggccgagctattttcgcccagtcctttcttcttcgcttgcgtcttcctctccatctgcatgcacctgttacatgaaagcgaacttggggacgtagggtttccagaaaatccgcttcggagccacacagcttcgccgggtgctgcaacatcccccctctctcggtaaacagttggtcgcgccccagtgctagcgggcgccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggtgagcgggcgacggggactcgccccgcccccccctcggtggcgtcgctcctggctgtagcggggaagtggacgcggcccgcccgggagccgagggggccgaggctgcagccgctgggcagcaggttgcgggggaggccttgcgtgggcggaagggggccgctcgcttctcggaatccctgcctttttctctcccatgcaccccctcccttttggggcttaagctcggtggaaaaagcccggagaaagatggggcgggcagacgggcgatttctggccgggcagcatccctgcttcaggtggtggcgtctcttcgg

SEQ ID NO: 305045 - DNA, 3890 bp, Homo sapiens
tggttatgtggttgctctgtgttgttccggatgtgccatgtaccaatgatttcttttgactggcacacttgtcgttgcccgtaagctgctggcaacgcaccaacgtggagaagtaggcgcctggggtatatatgctggccctccttcaatgtccctgtcgttcgcttcgtgctcattcagtgttcctgtcacgtgtgcactcgcgcgcttgttaaccaatacccggctaccagcatgtctgagtacacacacgcagagaagccagcaggggcgggccgggcccgaccactccgcaaaccgcagggggaacttgcggcaggccgagctattttcgcccagtcctttcttcttcgcttgcgtcttcctctccatctgcatgcacctgttacatgaaagcgaacttggggacgtagggtttccagaaaatccgcttcggagccacacagcttcgccgggtgctgcaacatcccccctctctcggtaaacagttggtcgcgccccagtgctagcgggcgccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcagcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacatggaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaactctgctagtaaa

SEQ ID NO: 305046 - DNA, 2883 bp, Homo sapiens
  misc_feature (553)..(553): n is a, c, g, or t
ttaaaagatggagtttcgctcttgttgtccaggctggagtgcagtggcgtgatctcggctcaccacaaccctccaccttctgggttcaagcgattctcctgcctcaacctccagagtagctgggattacaggcatacgccaccacacctagctaattttgtatttttagtaggcacggggtttctccatgttggtcaggctggtcttgaactcccgacctatggtaatccacctgccgtggcttcccaaagtgctgggattacaggcatgagccaccgcgcctggtgataaagtcttacaaagcacttagatgtgtagcatatatgtaaggcactgaaccttagcttctacttttttcactaactttagcagtagttaaatcctgctagtacttattactaacagtagttattttcttttcatttgtattaggaaaaatttataacttatacaaatagaaataacttctcatgtccttgtcatccagctttggcagttcagtttatgatcattgtgcttttgtagcccataagctttctctatgcccctcttnaaagttgttttacgaaaaatccctgacataccatttcactcataaacatttcagaatgtatgaaagactcttaaaacagaatcatagtaccattatcagctcctccagtcttgttattaaacatcttagtggcagctgcttaaggtaaaagctggcatttcaaaagcagtcggttggttttttgtttttgttgctttattggggaatgacatgggtccccttagagaattattaatacgacttacaggaaaaccccctttattaggcacaaaaatatcaattaggaaatactcctttagcactttgttctaaaatagtaaattttaaaatttgattcacattgcttttccgtggtagaataaatgaatatgctaagaattacaacaccctgtagtattcctggtaatagtaacaaccagaataatcagattaataatccacttcctgtactcatagatagttaacctgctttttatggtgccttagctacccaaagcctctggtggtcatctgctcccctttttgacaaagcatcaaaacccaattctaacattcaagagagggctgtattacaatgtaatttcaaataaaagacattatgttgtattttgattctggatctttagtggacaccttcaattattgttttgtaagctttaacaaagtttttccattggattccttcgcaagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacatggaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaactctgctagtaaa

SEQ ID NO: 305047 - DNA, 3817 bp, Homo sapiens
  misc_feature (3302)..(3302): n is a, c, g, or t
  misc_feature (3790)..(3790): n is a, c, g, or t
  misc_feature (3800)..(3800): n is a, c, g, or t
  misc_feature (3805)..(3805): n is a, c, g, or t
  misc_feature (3808)..(3809): n is a, c, g, or t
  misc_feature (3816)..(3816): n is a, c, g, or t
tggttatgtggttgctctgtgttgttccggatgtgccatgtaccaatgatttcttttgactggcacacttgtcgttgcccgtaagctgctggcaacgcaccaacgtggagaagtaggcgcctggggtatatatgctggccctccttcaatgtccctgtcgttcgcttcgtgctcattcagtgttcctgtcacgtgtgcactcgcgcgcttgttaaccaatacccggctaccagcatgtctgagtacacacacgcagagaagccagcaggggcgggccgggcccgaccactccgcaaaccgcagggggaacttgcggcaggccgagctattttcgcccagtcctttcttcttcgcttgcgtcttcctctccatctgcatgcacctgttacatgaaagcgaacttggggacgtagggtttccagaaaatccgcttcggagccacacagcttcgccgggtgctgcaacatcccccctctctcggtaaacagttggtcgcgccccagtgctagcgggcgccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcagcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcaccaaacaacatgtaatctacagtaataaaaaatatatctcattttgggctcaaagcattaatccagttactgaaaagagaatacaagtggagcaaacaagagatgaagatcttgatacagactcattggactgaatttcccccttccccccattgatggaagaatgttccagattctaaattgaggacttcattattaatggcattactgtgttatgattaacaaatttcctgtaaggtacacactacatactaaggtcggccatcattcctgtttttttttttttttttttttttaaccaagcttaaaatgaagctttgtgtttgaaagtaataacaagctcagacgaagatggtggttgtacattattcatctagaaaatataaaaattcattttgttttgaagctagttattaaactggaatagcagttatatccctgagaatggggcccttctcttgacattcctttgttgtttaattctttagaatcttaataaatgtttttttaatcctgagagattaaacagtagtagacttgttaagaatgaaactgtaaccaaaattttaaaataaagttttttttaaaaaaaaaacctgatttttagatattttttgttcttgtctatttgaattggttcataatatggcctgaactctaagccaaggtactagaaattaagatttcaattttaagtggttattttgtgattgacaataaaatggtaccttttgtgaaatgttagtgaatgttactggacgtcattcaagtttgatgaattggccaaaattttaaaaacagtgttatcttaagtctatttaactttaaagctaacttcagaactcattaatctgcttgttacatgcacaatgattaaattggtctattttaagatgcagctttaaaaaagaatggatgtagaagccattaaacatttataggtgtcatcttcccattgtggcctgtttgtccagtgaccctgaaattgctcttctagcaacacactatttgtgatgtcactgaaaagccagatatgatttaatctagcatgttaattagagttttgcttatatttatgctacggaactgcaccattctaagagctacagtcagttcctttgcagtctaggctattgacttattttaaggaaaacatttttagcttttacatagggattgtgggcatttagtcacaaaattccaatgtgttgaaatatttttgttaacatttgataggcagaataaagatgaaggaaagaagccagaagttaagaaagtggagaagaagcgaggttagttatttcactttctaagatacataaaattatacatggaaaagaagttatatagacataacttttcatgtattggttttggaataattttatactcatatcctacaaatagaatttttcaaatccctaatgggctttatataaattgcattgtattttaagcataatcaagtgaacttgcttgagttgtttatgtttantgctcattaattatttgatggtgtcaaattttagtacacttgctgaaagctggatgctttcccatttcagacaaatcccttggttaaacataaggaaaagcaggtgtttggggactggagagcagaggagttatcatatgcagactatttattttaggaaaaacgcagccaagtggtggttttgtgcttttacactgcatgttgcttttctcaaccactaaaaatggcaataagtacttattcttagttaagctattgtgcatatctttgagcttcttagtaaagattactaagaacattttttttttaagtccactaattcattatacttagcctgtatatagaaatactggttttggaaaaactgttcactgtttttcacatattttaatttgtagaaacatcaatggattctcgacttcaaaggatacatgctgagattaaaaattcactcaaaattgataatcttgtaagtgtttaacttcatntaatacttcngtatncanntatagcnt

SEQ ID NO: 305048 - DNA, 2392 bp, Homo sapiens
tggttatgtggttgctctgtgttgttccggatgtgccatgtaccaatgatttcttttgactggcacacttgtcgttgcccgtaagctgctggcaacgcaccaacgtggagaagtaggcgcctggggtatatatgctggccctccttcaatgtccctgtcgttcgcttcgtgctcattcagtgttcctgtcacgtgtgcactcgcgcgcttgttaaccaatacccggctaccagcatgtctgagtacacacacgcagagaagccagcaggggcgggccgggcccgaccactccgcaaaccgcagggggaacttgcggcaggccgagctattttcgcccagtcctttcttcttcgcttgcgtcttcctctccatctgcatgcacctgttacatgaaagcgaacttggggacgtagggtttccagaaaatccgcttcggagccacacagcttcgccgggtgctgcaacatcccccctctctcggtaaacagttggtcgcgccccagtgctagcgggcgccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcagcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcaccaaacaacatgtaatctacagtaataaaaaatatatctcattttgggctcaaagcattaatccagttactgaaaagagaatacaagtggagcaaacaagagatgaagatcttgatacagactcattggactgaatttcccccttccccccattgatggaagaatgttccagattctaaattgaggacttcattattaatggcattactgtgttatgattaacaaatttcctgtaaggtacacactacatactaaggtcggccatcattcctgtttttttttttttttttttttttaaccaagcttaaaatgaagctttgtgtttgaaagtaataacaagctcagacgaagatggtggttgtacattattcatctagaaaatataaaaattcattttgttttgaagctagttattaaactggaatagcagttatatccctgagaatggggcccttctcttgacattcctttgttgtttaattctttagaatcttaataaatgtttttttaatcctgagagattaaacagtagtagacttgttaagaatgaaactgtaaccaaaattttaaaataaagtttttttt

SEQ ID NO: 305049 - DNA, 2905 bp, Homo sapiens
  misc_feature (553)..(553): n is a, c, g, or t
ttaaaagatggagtttcgctcttgttgtccaggctggagtgcagtggcgtgatctcggctcaccacaaccctccaccttctgggttcaagcgattctcctgcctcaacctccagagtagctgggattacaggcatacgccaccacacctagctaattttgtatttttagtaggcacggggtttctccatgttggtcaggctggtcttgaactcccgacctatggtaatccacctgccgtggcttcccaaagtgctgggattacaggcatgagccaccgcgcctggtgataaagtcttacaaagcacttagatgtgtagcatatatgtaaggcactgaaccttagcttctacttttttcactaactttagcagtagttaaatcctgctagtacttattactaacagtagttattttcttttcatttgtattaggaaaaatttataacttatacaaatagaaataacttctcatgtccttgtcatccagctttggcagttcagtttatgatcattgtgcttttgtagcccataagctttctctatgcccctcttnaaagttgttttacgaaaaatccctgacataccatttcactcataaacatttcagaatgtatgaaagactcttaaaacagaatcatagtaccattatcagctcctccagtcttgttattaaacatcttagtggcagctgcttaaggtaaaagctggcatttcaaaagcagtcggttggttttttgtttttgttgctttattggggaatgacatgggtccccttagagaattattaatacgacttacaggaaaaccccctttattaggcacaaaaatatcaattaggaaatactcctttagcactttgttctaaaatagtaaattttaaaatttgattcacattgcttttccgtggtagaataaatgaatatgctaagaattacaacaccctgtagtattcctggtaatagtaacaaccagaataatcagattaataatccacttcctgtactcatagatagttaacctgctttttatggtgccttagctacccaaagcctctggtggtcatctgctcccctttttgacaaagcatcaaaacccaattctaacattcaagagagggctgtattacaatgtaatttcaaataaaagacattaagtagtagaaacacgatggccatgttgtattttgattctggatctttagtggacaccttcaattattgttttgtaagctttaacaaagtttttccattggattccttcgcaagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacatggaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaactctgctagtaaa

SEQ ID NO: 305050 - DNA, 2692 bp, Homo sapiens
  misc_feature (2177)..(2177): n is a, c, g, or t
  misc_feature (2665)..(2665): n is a, c, g, or t
  misc_feature (2675)..(2675): n is a, c, g, or t
  misc_feature (2680)..(2680): n is a, c, g, or t
  misc_feature (2683)..(2684): n is a, c, g, or t
  misc_feature (2691)..(2691): n is a, c, g, or t
tgaaaaatgttttaagccctctcagtcataataaggacaaattgaggattactctgtttacctctttataaattttttgttgttgctcattttaaccatggtgggggaggtattattttttcaatttagcaataattgtatctgtaataagctactaatattcttaaatagtatgtatcatttctaatatttatatctgagatttgtatcttaaatagaaactagtagttactgattttttttccatgtgtatattagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcaccaaacaacatgtaatctacagtaataaaaaatatatctcattttgggctcaaagcattaatccagttactgaaaagagaatacaagtggagcaaacaagagatgaagatcttgatacagactcattggactgaatttcccccttccccccattgatggaagaatgttccagattctaaattgaggacttcattattaatggcattactgtgttatgattaacaaatttcctgtaaggtacacactacatactaaggtcggccatcattcctgtttttttttttttttttttttttaaccaagcttaaaatgaagctttgtgtttgaaagtaataacaagctcagacgaagatggtggttgtacattattcatctagaaaatataaaaattcattttgttttgaagctagttattaaactggaatagcagttatatccctgagaatggggcccttctcttgacattcctttgttgtttaattctttagaatcttaataaatgtttttttaatcctgagagattaaacagtagtagacttgttaagaatgaaactgtaaccaaaattttaaaataaagttttttttaaaaaaaaaacctgatttttagatattttttgttcttgtctatttgaattggttcataatatggcctgaactctaagccaaggtactagaaattaagatttcaattttaagtggttattttgtgattgacaataaaatggtaccttttgtgaaatgttagtgaatgttactggacgtcattcaagtttgatgaattggccaaaattttaaaaacagtgttatcttaagtctatttaactttaaagctaacttcagaactcattaatctgcttgttacatgcacaatgattaaattggtctattttaagatgcagctttaaaaaagaatggatgtagaagccattaaacatttataggtgtcatcttcccattgtggcctgtttgtccagtgaccctgaaattgctcttctagcaacacactatttgtgatgtcactgaaaagccagatatgatttaatctagcatgttaattagagttttgcttatatttatgctacggaactgcaccattctaagagctacagtcagttcctttgcagtctaggctattgacttattttaaggaaaacatttttagcttttacatagggattgtgggcatttagtcacaaaattccaatgtgttgaaatatttttgttaacatttgataggcagaataaagatgaaggaaagaagccagaagttaagaaagtggagaagaagcgaggttagttatttcactttctaagatacataaaattatacatggaaaagaagttatatagacataacttttcatgtattggttttggaataattttatactcatatcctacaaatagaatttttcaaatccctaatgggctttatataaattgcattgtattttaagcataatcaagtgaacttgcttgagttgtttatgtttantgctcattaattatttgatggtgtcaaattttagtacacttgctgaaagctggatgctttcccatttcagacaaatcccttggttaaacataaggaaaagcaggtgtttggggactggagagcagaggagttatcatatgcagactatttattttaggaaaaacgcagccaagtggtggttttgtgcttttacactgcatgttgcttttctcaaccactaaaaatggcaataagtacttattcttagttaagctattgtgcatatctttgagcttcttagtaaagattactaagaacattttttttttaagtccactaattcattatacttagcctgtatatagaaatactggttttggaaaaactgttcactgtttttcacatattttaatttgtagaaacatcaatggattctcgacttcaaaggatacatgctgagattaaaaattcactcaaaattgataatcttgtaagtgtttaacttcatntaatacttcngtatncanntatagcnt

SEQ ID NO: 305051 - DNA, 1317 bp, Homo sapiens
tggttatgtggttgctctgtgttgttccggatgtgccatgtaccaatgatttcttttgactggcacacttgtcgttgcccgtaagctgctggcaacgcaccaacgtggagaagtaggcgcctggggtatatatgctggccctccttcaatgtccctgtcgttcgcttcgtgctcattcagtgttcctgtcacgtgtgcactcgcgcgcttgttaaccaatacccggctaccagcatgtctgagtacacacacgcagagaagccagcaggggcgggccgggcccgaccactccgcaaaccgcagggggaacttgcggcaggccgagctattttcgcccagtcctttcttcttcgcttgcgtcttcctctccatctgcatgcacctgttacatgaaagcgaacttggggacgtagggtttccagaaaatccgcttcggagccacacagcttcgccgggtgctgcaacatcccccctctctcggtaaacagttggtcgcgccccagtgctagcgggcgccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcagcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagacgtaagtcctgttagctttaaaggcaaatcagagctaatttaacagggttattaggcagtagacattaattcaagggggaaatcgtaacgtaataggaaactttaaaatctttgaactttggaaagagtctttaagtctctatttttaaggtagcgtttacagatgctataggtttattttttactggaattgatatttccttaaccaaaaaggaaagtagaaattctctgagcaataagaatgattgatggatgaaaatacataaggaaagttttaataagtgatctgatattcctatacagtaaaataagtgctttttataaggactagttggtacc

SEQ ID NO: 305052 - DNA, 407 bp, Homo sapiens
ttactgttaaaacgatagtgaaaaatgttttaagccctctcagtcataataaggacaaattgaggattactctgtttacctctttataaattttttgttgttgctcattttaaccatggtgggggaggtattattttttcaatttagcaataattgtatctgtaataagctactaatattcttaaatagtatgtatcatttctaatatttatatctgagatttgtatcttaaatagaaactagtagttactgattttttttccatgtgtatattagctacagaagtcaagattccaaaaccaagaggcagacccaaaatggtaaaacagccctgtccttcagagagtgacatgtgagtttatttttaatgtataattatgcaataaatgagacatttgactttaaac

SEQ ID NO: 305053 - DNA, 417 bp, Homo sapiens
tgaaatgcattatgcaaaataaagtttattgtattgtattcccagccaaacaacatgtaatctacagtaataaaaaatatatctcattttgggctcaaagcattaatccagttactgaaaagagaatacaagtggagcaaacaagagatgaagatcttgatacagactcattggactgaatttcccccttccccccattgatggaagaatgttccagattctaaattgaggacttcattattaatggcattactgtgttatgattaacaaatttcctgtaaggtacacactacatactaaggtcggccatcattcctgtttttttttttttttttttttttaaccaagcttaaaatgaagctttgtgtttgaaagtaataacaagctcagacgaagatggtggttgtacattattca

SEQ ID NO: 305054 - DNA, 1369 bp, Homo sapiens
ttttgtctttaagctttggggggatttatgttgcgtttccaaactgcttctgcctgtcggcgcctgtgtggaaactgcgacgagtctgggagcggctgccggagaggcggggcagaggtgtgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagagtcatctgattggagccacatttcatttgatggaattttccatttgaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 305055 - DNA, 1322 bp, Homo sapiens
ttttgtctttaagctttggggggatttatgttgcgtttccaaactgcttctgcctgtcggcgcctgtgtggaaactgcgacgagtctgggagcggctgccggagaggcggggcagaggtgtgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 305056 - DNA, 437 bp, Homo sapiens
ttcgagttcggtacccaatcagtttacacaaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 305057 - DNA, 477 bp, Homo sapiens
caaaaagtaacccggagaataaaaaatcattttaataagcttatgtcatgaggtctttactacagcaactctcttcctgtctctttcaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 305058 - DNA, 906 bp, Homo sapiens
  misc_feature (140)..(140): n is a, c, g, or t
  misc_feature (862)..(862): n is a, c, g, or t
  misc_feature (870)..(870): n is a, c, g, or t
ccaaaaccctcatgtcccgatatcaccgtggaatccaggatttttggccatagggccttcccagttaaatgttaaccaagccagggctctaacacacaagtctcggacttaagtcgcagggctcttttaattaccaccgntacagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatgactagatcggccagaccncccaatcntttcttcttccattctcgctctcttcttctatcttt

SEQ ID NO: 305059 - DNA, 350 bp, Homo sapiens
gtaaaaaggtaaaacatttacagccacacaaaaaattcgttaggtaactgaataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 305060 - DNA, 1071 bp, Homo sapiens
  misc_feature (44)..(44): n is a, c, g, or t
  misc_feature (47)..(47): n is a, c, g, or t
  misc_feature (67)..(67): n is a, c, g, or t
  misc_feature (80)..(80): n is a, c, g, or t
ataaaacataaaagacgacgaacaagggggggggggaggggggntanctgcaacgactctcttaatntccaccgctacanaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 305061 - DNA, 1438 bp, Homo sapiens
ttttgtctttaagctttggggggatttatgttgcgtttccaaactgcttctgcctgtcggcgcctgtgtggaaactgcgacgagtctgggagcggctgccggagaggcggggcagaggtgtgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagggcccctcccagtgtcttcaagagtttgtgcaagcaaatacctgaaaacctaaggaaaatgatgggaaactgaacttcagatacttatcaaaaagaagatgaaggtagggattgagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 305062 - DNA, 1702 bp, Homo sapiens
ttttgtctttaagctttggggggatttatgttgcgtttccaaactgcttctgcctgtcggcgcctgtgtggaaactgcgacgagtctgggagcggctgccggagaggcggggcagaggtgtgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagtgcttgtcaaaatgctatgacaactgactggttttatgcaaacagagcctggctctcaagagacagtgtgtctgaaagtcaaacatggatggcagccattggcacacaaaggagtcagaaaccacagattgttttctcgttggatgaacagcttaaagcaacgtaaagttaattgaagaattccttgaaagtgaagtcagactaaaaagaaatgctccgagtctataatttactaaatgtgaaagaacttgttgtcttccttccccacccactttcagaaaggatttgatgttgcctagggttaaaatagataaataaaatcaaaaccattaggatgaatacgaaggaacggggaaagatgttatactcgaatccctgagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 305063 - DNA, 1419 bp, Homo sapiens
gggtcttctagttttgacagagaattagaaagagagaaagaacgccagcgactagagcgtgaagccaaagaaagggagaaagaacggcgaagatcccgaagtattgaccgggggttagaacgcaggcgcagcagaagtagggaaaggcatagaagtcgcagtcgaagtcgtgataggaaaggggatagaagggacagggatcgagaaagagagaaagaaaatgagagaggtagaagacgagatcgtgactatgataaggaaagaggaaatgaacgagaaaaagagagagagcgatcaagagaaaggtccaaggaacagagaagtaggggagaggtagaagagaagaaacataaagaagacaaagatgataggcggcacagagatgacaaaagagattccaagaaagagaaaaaacaccagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 305064 - DNA, 1397 bp, Homo sapiens
ttttgtctttaagctttggggggatttatgttgcgtttccaaactgcttctgcctgtcggcgcctgtgtggaaactgcgacgagtctgggagcggctgccggagaggcggggcagaggtgtgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccaggtttttaaaactcatttggacacccacctcaatatatgctgtgcaattagaataatccagaagactgaaagagtaaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 305065 - DNA, 1473 bp, Homo sapiens
ttttgtctttaagctttggggggatttatgttgcgtttccaaactgcttctgcctgtcggcgcctgtgtggaaactgcgacgagtctgggagcggctgccggagaggcggggcagaggtgtgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatgaaaacaacaaccaccccacaaaaaaacacctcgcggggccctaaggggggggggggaaaaaaagggctcacggggccgggccatagggggcccgaacccttcttgcccagggggaaacggcgggccccaaaggggcgcaaatcgaaaccggc

SEQ ID NO: 305066 - DNA, 1261 bp, Homo sapiens
ttttgtctttaagctttggggggatttatgttgcgtttccaaactgcttctgcctgtcggcgcctgtgtggaaactgcgacgagtctgggagcggctgccggagaggcggggcagaggtgtgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 305067 - DNA, 1383 bp, Homo sapiens
  misc_feature (1339)..(1339): n is a, c, g, or t
  misc_feature (1347)..(1347): n is a, c, g, or t
ttttgtctttaagctttggggggatttatgttgcgtttccaaactgcttctgcctgtcggcgcctgtgtggaaactgcgacgagtctgggagcggctgccggagaggcggggcagaggtgtgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatgactagatcggccagaccncccaatcntttcttcttccattctcgctctcttcttctatcttt

SEQ ID NO: 305068 - DNA, 1796 bp, Homo sapiens
  misc_feature (1467)..(1467): n is a, c, g, or t
  misc_feature (1629)..(1629): n is a, c, g, or t
ttttgtctttaagctttggggggatttatgttgcgtttccaaactgcttctgcctgtcggcgcctgtgtggaaactgcgacgagtctgggagcggctgccggagaggcggggcagaggtgtgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatgaaaaaaaaaaaaaaatataaggatacaatatagataatactaaaatagatgaatcgaaaagaagagggcgggacctataatagatgtaacacactcagggggaggcccatgaattataggagcgtcaaccaactattttagagacnagaaagggggctacaccataaatgaagaggacacaaaaatcatatgacagaacgagtctaggtctggagctgcctatacacaacccagcttgtctcgtgtaagtgaataaacattcgattagtcctgttagaagtatatctatggggagaagaaaacaacanagttcattgggtgtgagagaaataagggtgacaactaagtcattgataagagtaaagggagctgtagaggtataagattaagtgtaaatcagttcttgacttagtatacgctagacagtgttggtactgaggtgtaactgtgctaagtagagtatgatgtaaaacta

SEQ ID NO: 305069 - DNA, 1386 bp, Homo sapiens
ttttgtctttaagctttggggggatttatgttgcgtttccaaactgcttctgcctgtcggcgcctgtgtggaaactgcgacgagtctgggagcggctgccggagaggcggggcagaggtgtgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatgaggcaggcgtgcctgcttcgattctacattatatataatattctgtgattatcagtctttataag

SEQ ID NO: 305070 - DNA, 1384 bp, Homo sapiens
ttttgtctttaagctttggggggatttatgttgcgtttccaaactgcttctgcctgtcggcgcctgtgtggaaactgcgacgagtctgggagcggctgccggagaggcggggcagaggtgtgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatgatggtacgcgcgcaaggcattaatctcgttaaatacataataataatagttgcgacgcagtac

SEQ ID NO: 305071 - DNA, 720 bp, Homo sapiens
  misc_feature (44)..(44): n is a, c, g, or t
  misc_feature (47)..(47): n is a, c, g, or t
  misc_feature (67)..(67): n is a, c, g, or t
  misc_feature (80)..(80): n is a, c, g, or t
ataaaacataaaagacgacgaacaagggggggggggaggggggntanctgcaacgactctcttaatntccaccgctacantttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 305072 - DNA, 1054 bp, Homo sapiens
ttttgtctttaagctttggggggatttatgttgcgtttccaaactgcttctgcctgtcggcgcctgtgtggaaactgcgacgagtctgggagcggctgccggagaggcggggcagaggtgtgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagattaaaaaggtggtatggtggtatagccctg

SEQ ID NO: 305073 - DNA, 602 bp, Homo sapiens
ctactactactaaattcgcggctgctcgacgatcatctgcagctcggccgtccgacgcctggagcgtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 305074 - DNA, 1313 bp, Homo sapiens
  misc_feature (851)..(851): n is a, c, g, or t
  misc_feature (856)..(856): n is a, c, g, or t
  misc_feature (867)..(867): n is a, c, g, or t
  misc_feature (872)..(872): n is a, c, g, or t
  misc_feature (874)..(874): n is a, c, g, or t
  misc_feature (878)..(878): n is a, c, g, or t
  misc_feature (881)..(881): n is a, c, g, or t
  misc_feature (893)..(893): n is a, c, g, or t
  misc_feature (900)..(900): n is a, c, g, or t
  misc_feature (915)..(915): n is a, c, g, or t
  misc_feature (918)..(918): n is a, c, g, or t
  misc_feature (920)..(920): n is a, c, g, or t
  misc_feature (925)..(925): n is a, c, g, or t
ttttgtctttaagctttggggggatttatgttgcgtttccaaactgcttctgcctgtcggcgcctgtgtggaaactgcgacgagtctgggagcggctgccggagaggcggggcagaggtgtgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaagccagncgcangtaagttgctngaaancntgtngtncacctgggtgtngaactcngggaaattaaagacntgntnaacangtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 305075 - DNA, 1181 bp, Homo sapiens
  misc_feature (44)..(44): n is a, c, g, or t
  misc_feature (47)..(47): n is a, c, g, or t
  misc_feature (67)..(67): n is a, c, g, or t
  misc_feature (80)..(80): n is a, c, g, or t
  misc_feature (719)..(719): n is a, c, g, or t
  misc_feature (724)..(724): n is a, c, g, or t
  misc_feature (735)..(735): n is a, c, g, or t
  misc_feature (740)..(740): n is a, c, g, or t
  misc_feature (742)..(742): n is a, c, g, or t
  misc_feature (746)..(746): n is a, c, g, or t
  misc_feature (749)..(749): n is a, c, g, or t
  misc_feature (761)..(761): n is a, c, g, or t
  misc_feature (768)..(768): n is a, c, g, or t
  misc_feature (783)..(783): n is a, c, g, or t
  misc_feature (786)..(786): n is a, c, g, or t
  misc_feature (788)..(788): n is a, c, g, or t
  misc_feature (793)..(793): n is a, c, g, or t
ataaaacataaaagacgacgaacaagggggggggggaggggggntanctgcaacgactctcttaatntccaccgctacanggtaagcatcttgccttactcagatggttaccaaaactggaggcaaaatccaccttgattcggcctactgagagacagtattggcttcctgcatgatgccttcctaggggatttgcaagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaagccagncgcangtaagttgctngaaancntgtngtncacctgggtgtngaactcngggaaattaaagacntgntnaacangtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 305076 - DNA, 1084 bp, Homo sapiens
ttttgtctttaagctttggggggatttatgttgcgtttccaaactgcttctgcctgtcggcgcctgtgtggaaactgcgacgagtctgggagcggctgccggagaggcggggcagaggtgtgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 305077 - DNA, 575 bp, Homo sapiens
cttgcagaccatggtaaggagtttgaatgctgttgttaggtccaatgggaagctgttaaagaatttctaagtactgaaatgatggggttggatttatattgattaaattttactctggctattctgggaatttaggagacgaataataataatgacaaagcaaatgcaactaacatttattaaacactaatgccaggcagcatgctaattgctttatacagattattttagttaattcttacatcattccattgagttaaatgatatcattatcccagttttgcagatgaggaaactcagacacactgaagctaagtaatttgcctgaagtcacacagctaacctatcaaacccaggctgtcatttttcagcctttgctcttacttagcccttaacctttactacttttgactcttcttccagtactggattcaagataagcatttaggaggttattgctatattccaggcaacagctggtggttgtttggcctttctgctaaggtggtttttctgttgttccttgtaagtttaatattcattcttacagatggagtatgatttaattcacgttg

SEQ ID NO: 305078 - DNA, 4422 bp, Homo sapiens
gattattctggaggaagatgaccttcattttatggttatgtgtgtgtgtctgtgtgtctttggaaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattaagctttcagtataaaaacaagtggctacctgatggaaacttttcttacccttatagggaaactgagcacaagctgaatgatattgtctgctgcaaaaaaaaacaaacaaaaaaaaaacaaaacaaaaaacaaaaaaaaaaaaaaaaaaacctcgtgccgaattcggcacgtgggggaagccccgtgcaccccccgccctccggccgccgccgccccgctggccctgcagccgtcgccgctgcctcgggctacagccccgggctcggcggtcccggctggggaaggagggcggcgagcgcgtccggagccgccggagatggcgggagggcactgcggcagcttccccgcggcggcggccggcagcggcgagatcgtccaactgaacgtaggggggaccagatttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagaatcaaagaatcttcaggatggcagcaagtgtttacgagcccatatttggattggactatcgaacgagtagctttaaatgcaaaggtggttggagggccacatggagacaaagacaaaatggttgctgttgcctcagagagtagcatcatcttgtggagtgttcaggatgggggaagtggaagtgaaattggagtgttcagcctgggtgttcctgtagatgctctcttctttattggtaaccagttggtggccacgagtcatacagggaaagtgggagtgtggaatgctgtcactcagcactggcaggttcaagatgttgttcctataactagttatgacactgctggatcattccttctgcttggatgtaacaatggatcaatatattacatagatatgcagaagttccccttgcgaatgaaagataatgatcttcttgtaactgaactgtatcatgatccttcaaatgatgctattactgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtggattggaagtgcataaaatagctgaaggtttttcagaatccaagaaaaggtcatcagaagatgaaaatgaaaataaaatagagtttaggaagaaaggaggatttgaagggggaggattccttggaagaaagaaagttccctatctggcatcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcgttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaattta

SEQ ID NO: 305079 - DNA, 2532 bp, Homo sapiens
agcgtgagcgctgcggtattttgtcccgaacggtgacccctcctcccaggcaggctgcggcggcgtcggtggcagcggagcacggagaagaggcccgggcggcccggcggcctggaggccgcgaaaggtggaggccgggccgcccttgtgcaccgcaggattgacccgggaaggggcagaagctagcgagccccgcccggccgccgggaaggtgggggaagccccgtgcaccccccgccctccggccgccgccgccccgctggccctgcagccgtcgccgctgcctcgggctacagccccgggctcggcggtcccggctggggaaggagggcggcgagcgcgtccggagccgccggagatggcgggagggcactgcggcagcttccccgcggcggcggccggcagcggcgagatcgtccaactgaacgtaggggggaccagatttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagaatcaaagaatcttcaggatggcagcaagtgtttacgagcccatatttggattggactatcgaacgagtagctttaaatgcaaaggtggttggagggccacatggagacaaagacaaaatggttgctgttgcctcagagagtagcatcatcttgtggagtgttcaggatgggggaagtggaagtgaaattggagtgttcagcctgggtgttcctgtagatgctctcttctttattggtaaccagttggtggccacgagtcatacagggaaagtgggagtgtggaatgctgtcactcagcactggcaggttcaagatgttgttcctataactagttatgacactgctggatcattccttctgcttggatgtaacaatggatcaatatattacatagatatgcagaagttccccttgcgaatgaaagataatgatcttcttgtaactgaactgtatcatgatccttcaaatgatgctattactgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtgg

SEQ ID NO: 305080 - DNA, 534 bp, Homo sapiens
ctggtattctagagggggacccagacaacacacacacaggggcgagactatttcagactgtgttaagccctataaaagaatgcatagacagagaagaccaggggacaggggagcaacttggctcttggagagtgacacttgagtggagtcagaatgcattcggggtggaggggacagtagactcaaaggccctggggtgggaacactctggaacaagaagagagtcattgtggctgcagtgaggaagaaggaaatcaggtctgagaggtcagtaagggccactacataggttcaagatgttgttcctataactagttatgacactgctggatcattccttctgcttggatgtaacaatggatcaatatattacatagatatgcagaagttccccttgcgaatgaaagataatgatcttcttgtaactgaactgtatcatgatccttcaaatgatgctattactgctctgagtgtttacctcacacccaaaacaatgtcagtggtaactggatcgaggtctccgtcgatgtgatc

SEQ ID NO: 305081 - DNA, 319 bp, Homo sapiens
ccaacaggagatgtgttgaaccggagtagctgcctacagcagtgtattgaaccggatagctagccggcaagctatccggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtgg

SEQ ID NO: 305082 - DNA, 3984 bp, Homo sapiens
agcgtgagcgctgcggtattttgtcccgaacggtgacccctcctcccaggcaggctgcggcggcgtcggtggcagcggagcacggagaagaggcccgggcggcccggcggcctggaggccgcgaaaggtggaggccgggccgcccttgtgcaccgcaggattgacccgggaaggggcagaagctagcgagccccgcccggccgccgggaaggtgggggaagccccgtgcaccccccgccctccggccgccgccgccccgctggccctgcagccgtcgccgctgcctcgggctacagccccgggctcggcggtcccggctggggaaggagggcggcgagcgcgtccggagccgccggagatggcgggagggcactgcggcagcttccccgcggcggcggccggcagcggcgagatcgtccaactgaacgtaggggggaccagatttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagaatcaaagaatcttcaggatggcagcaagtgtttacgagcccatatttggattggactatcgaacgagtagctttaaatgcaaaggtggttggagggccacatggagacaaagacaaaatggttgctgttgcctcagagagtagcatcatcttgtggagtgttcaggatgggggaagtggaagtgaaattggagtgttcagcctgggtgttcctgtagatgctctcttctttattggtaaccagttggtggccacgagtcatacagggaaagtgggagtgtggaatgctgtcactcagcactggcaggttcaagatgttgttcctataactagttatgacactgctggatcattccttctgcttggatgtaacaatggatcaatatattacatagatatgcagaagttccccttgcgaatgaaagataatgatcttcttgtaactgaactgtatcatgatccttcaaatgatgctattactgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtggattggaagtgcataaaatagctgaaggtttttcagaatccaagaaaaggtcatcagaagatgaaaatgaaaataaaatagagtttaggaagaaaggaggatttgaagggggaggattccttggaagaaagaaagttccctatctggcatcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcgttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaatttactatattgccagtggtttcacaacagttctcttgtatttatttatcaattaaatcaaataaaaat

SEQ ID NO: 305083 - DNA, 3149 bp, Homo sapiens
tgattaatgtgatagagtaatgtcatttttaggtgtgatgacagtcagttatgtgtgacgaataggataactgaaaaaatatgaaaggctatgatgtcagaaagtattatgggacaagatcgtaaaaccagtgttacccagggagtatgaatttaatatgggaattcttaactcctttatgactggaagatgagcatcagagtgtctgcgaccatttgatgatattatgtaccaagttttagatgtttggcttttttcaggttatgaaagcgggggatgagttaagaaccactgctgtgaaggattcatcaactatttttaggcagttgggtaaaaatgaccaatttagttttaagaaactgactgtggctccagagtatgttggagaagtgaaaatggagactaggaataacagggaaagtgggagtgtggaatgctgtcactcagcactggcaggttcaagatgttgttcctataactagttatgacactgctggatcattccttctgcttggatgtaacaatggatcaatatattacatagatatgcagaagttccccttgcgaatgaaagataatgatcttcttgtaactgaactgtatcatgatccttcaaatgatgctattactgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtggattggaagtgcataaaatagctgaaggtttttcagaatccaagaaaaggtcatcagaagatgaaaatgaaaataaaatagagtttaggaagaaaggaggatttgaagggggaggattccttggaagaaagaaagttccctatctggcatcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcgttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaatttactatattgccagtggtttcacaacagttctcttgtatttatttatcaattaaatcaaataaaaat

SEQ ID NO: 305084 - DNA, 4581 bp, Homo sapiens
agcgtgagcgctgcggtattttgtcccgaacggtgacccctcctcccaggcaggctgcggcggcgtcggtggcagcggagcacggagaagaggcccgggcggcccggcggcctggaggccgcgaaaggtggaggccgggccgcccttgtgcaccgcaggattgacccgggaaggggcagaagctagcgagccccgcccggccgccgggaaggtgggggaagccccgtgcaccccccgccctccggccgccgccgccccgctggccctgcagccgtcgccgctgcctcgggctacagccccgggctcggcggtcccggctggggaaggagggcggcgagcgcgtccggagccgccggagatggcgggagggcactgcggcagcttccccgcggcggcggccggcagcggcgagatcgtccaactgaacgtaggggggaccagatttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagaatcaaagaatcttcaggatggcagcaagtgtttacgagcccatatttggattggactatcgaacgagtagctttaaatgcaaaggtggttggagggccacatggagacaaagacaaaatggttgctgttgcctcagagagtagcatcatcttgtggagtgttcaggatgggggaagtggaagtgaaattggagtgttcagcctgggtgttcctgtagatgctctcttctttattggtaaccagttggtggccacgagtcatacagggaaagtgggagtgtggaatgctgtcactcagcactggcaggttcaagatgttgttcctataactagttatgacactgctggatcattccttctgcttggatgtaacaatggatcaatatattacatagatatgcagaagttccccttgcgaatgaaagataatgatcttcttgtaactgaactgtatcatgatccttcaaatgatgctattactgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtggattggaagtgcataaaatagctgaaggtttttcagaatccaagaaaaggtcatcagaagatgaaaatgaaaataaaatagagtttaggaagaaaggaggatttgaagggggaggattccttggaagaaagaaagttccctatctggcatcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcgttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaatttactatattgccagtggtttcacaacagttctcttgtatttatttatcaattaaatcaaataaaaatgattatgtcaatgcgttttcagttatttaagtaacagttctgtttaaagtgtgctatatatgtttgttcatttctttgcttcttcccataatttaaaaaaaatggggggagggagaacttaatatatgtggaaaataagttattatcaatgaaagaaaatattaggcaaagcataatttcaaaattactaagattgtaattatcttacacccttcttcctctttatgacagttatgtgaaagttgggtgggcaagtaagaaaatgaaagaaaaaactagactctagtgaccaggaataaaaggccattaaaaagaagatagtaactattatgtaatagaatcgcataaaaaggaaactgactatactagattgcattacagtacaagtcaaatcgtttctttcttttgcttacaggagattgaaccttgatgcagtggtttatgtctgtctactctgacactaatttctcagattgcccccattatgccttaattttttcattatacctacctcattagggtcgctgtggtgggaagaaaaaaaattgaaatgagtctgtgtactttgtgtgattgatgatgaaaaatgaaaacaat

SEQ ID NO: 305085 - DNA, 2658 bp, Homo sapiens
tacgggatatcggtcgaaccagccctcgagtatattgaggcattgttacatagatatgcagaagttccccttgcgaatgaaagataatgatcttcttgtaactgaactgtatcatgatccttcaaatgatgctattactgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtggattggaagtgcataaaatagctgaaggtttttcagaatccaagaaaaggtcatcagaagatgaaaatgaaaataaaatagagtttaggaagaaaggaggatttgaagggggaggattccttggaagaaagaaagttccctatctggcatcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcgttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaatttactatattgccagtggtttcacaacagttctcttgtatttatttatcaattaaatcaaataaaaat

SEQ ID NO: 305086 - DNA, 2712 bp, Homo sapiens
accttgagctcaagaatgagactaggatagtctttatcactacatgtgggcatgtaggaattatctttttccctcctttttgtccggcctactaggaagctcatctaagcttcatattctattcctgtatgcttctcaaattcatgtggattgtatttttttttgtctatttttttgaccttgcgtttgcctatactgatttttcttttttaataaactccctcaactcttttgaagtaggctgggataactaattcagtcaagtacaattcagttagcccttacgtgactttggaacaatcatttgctgatgttatcccattgtttcctgatccgtcaatgtggataaaaattgttctctctcaggttcttttatcttttatgaaaatcaactaaaaagtcataaaaatctttttttgaagttgagtattatcctaatgatggatacaatatgggccatctccatagagctgtatattttttctggtttcagattttaaagatttacacataaattttaaatgattttttaaaagtcttttctagtataacatgtttgctttctttctttctgtctttttagtttcatagcttctttttaaataattgctcattcccatcagggctctttctgcttttcttttgcagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtggattggaagtgcataaaatagctgaaggtttttcagaatccaagaaaaggtcatcagaagatgaaaatgaaaataaaatagagtttaggaagaaaggaggatttgaagggggaggattccttggaagaaagaaagttccctatctggcatcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcgttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaatttactatattgccagtggtttcacaacagttctcttgtatttatttatcaattaaatcaaataaaaat

SEQ ID NO: 305087 - DNA, 3690 bp, Homo sapiens
  misc_feature (3678)..(3678): n is a, c, g, or t
  misc_feature (3684)..(3687): n is a, c, g, or t
agcgtgagcgctgcggtattttgtcccgaacggtgacccctcctcccaggcaggctgcggcggcgtcggtggcagcggagcacggagaagaggcccgggcggcccggcggcctggaggccgcgaaaggtggaggccgggccgcccttgtgcaccgcaggattgacccgggaaggggcagaagctagcgagccccgcccggccgccgggaaggtgggggaagccccgtgcaccccccgccctccggccgccgccgccccgctggccctgcagccgtcgccgctgcctcgggctacagccccgggctcggcggtcccggctggggaaggagggcggcgagcgcgtccggagccgccggagatggcgggagggcactgcggcagcttccccgcggcggcggccggcagcggcgagatcgtccaactgaacgtaggggggaccagatttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagaatcaaagaatcttcaggatggcagcaagtgtttacgagcccatatttggattggactatcgaacgagtagctttaaatgcaaaggtggttggagggccacatggagacaaagacaaaatggttgctgttgcctcagagagtagcatcatcttgtggagtgttcaggatgggggaagtggaagtgaaattggagtgttcagcctgggtgttcctgtagatgctctcttctttattggtaaccagttggtggccacgagtcatacagggaaagtgggagtgtggaatgctgtcactcagcactggcaggttcaagatgttgttcctataactagttatgacactgctggatcattccttctgcttggatgtaacaatggatcaatatattacatagatatgcagaagttccccttgcgaatgaaagataatgatcttcttgtaactgaactgtatcatgatccttcaaatgatgctattactgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtggattggaagtgcataaaatagctgaaggtttttcagaatccaagaaaaggtcatcagaagatgaaaatgaaaataaaatagagtttaggaagaaaggaggatttgaagggggaggattccttggaagaaagaaagttccctatctggcatcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcgttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattccattgaaactttcaagttggagcaattgtctgtgtttgaaaagatgaaataaaaataataatcaagggcaaagctttgagtgcccagaagggaaagctgtaccagttgctaacctgtcttgtttcaggagcggcacatgcgttgggagcggcacaggcgttgggggctcaactagagtcggcctctactgtacgtagctaaaatcaaacaanccaggnnnncct

SEQ ID NO: 305088 - DNA, 3919 bp, Homo sapiens
  misc_feature (3375)..(3375): n is a, c, g, or t
  misc_feature (3394)..(3394): n is a, c, g, or t
  misc_feature (3422)..(3422): n is a, c, g, or t
  misc_feature (3435)..(3435): n is a, c, g, or t
  misc_feature (3439)..(3439): n is a, c, g, or t
  misc_feature (3444)..(3444): n is a, c, g, or t
  misc_feature (3462)..(3462): n is a, c, g, or t
  misc_feature (3473)..(3473): n is a, c, g, or t
  misc_feature (3477)..(3477): n is a, c, g, or t
  misc_feature (3487)..(3487): n is a, c, g, or t
  misc_feature (3495)..(3495): n is a, c, g, or t
  misc_feature (3497)..(3497): n is a, c, g, or t
  misc_feature (3518)..(3518): n is a, c, g, or t
  misc_feature (3520)..(3521): n is a, c, g, or t
  misc_feature (3529)..(3529): n is a, c, g, or t
agcgtgagcgctgcggtattttgtcccgaacggtgacccctcctcccaggcaggctgcggcggcgtcggtggcagcggagcacggagaagaggcccgggcggcccggcggcctggaggccgcgaaaggtggaggccgggccgcccttgtgcaccgcaggattgacccgggaaggggcagaagctagcgagccccgcccggccgccgggaaggtgggggaagccccgtgcaccccccgccctccggccgccgccgccccgctggccctgcagccgtcgccgctgcctcgggctacagccccgggctcggcggtcccggctggggaaggagggcggcgagcgcgtccggagccgccggagatggcgggagggcactgcggcagcttccccgcggcggcggccggcagcggcgagatcgtccaactgaacgtaggggggaccagatttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagaatcaaagaatcttcaggatggcagcaagtgtttacgagcccatatttggattggactatcgaacgagtagctttaaatgcaaaggtggttggagggccacatggagacaaagacaaaatggttgctgttgcctcagagagtagcatcatcttgtggagtgttcaggatgggggaagtggaagtgaaattggagtgttcagcctgggtgttcctgtagatgctctcttctttattggtaaccagttggtggccacgagtcatacagggaaagtgggagtgtggaatgctgtcactcagcactggcaggttcaagatgttgttcctataactagttatgacactgctggatcattccttctgcttggatgtaacaatggatcaatatattacatagatatgcagaagttccccttgcgaatgaaagataatgatcttcttgtaactgaactgtatcatgatccttcaaatgatgctattactgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtggattggaagtgcataaaatagctgaaggtttttcagaatccaagaaaaggtcatcagaagatgaaaatgaaaataaaatagagtttaggaagaaaggaggatttgaagggggaggattccttggaagaaagaaagttccctatctggcatcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcgttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggacnaccccaactcacccgtgcnccattctctgacccccaccattgggagnccccaaccccccncaancattngcaataccaaaccccccnaccccaccgancccnccaaggtggngcaattgncngtgtgggaaaagaggaggggngnnggagaggnaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaattta

SEQ ID NO: 305089 - DNA, 1256 bp, Homo sapiens
agcgtgagcgctgcggtattttgtcccgaacggtgacccctcctcccaggcaggctgcggcggcgtcggtggcagcggagcacggagaagaggcccgggcggcccggcggcctggaggccgcgaaaggtggaggccgggccgcccttgtgcaccgcaggattgacccgggaaggggcagaagctagcgagccccgcccggccgccgggaaggtgggggaagccccgtgcaccccccgccctccggccgccgccgccccgctggccctgcagccgtcgccgctgcctcgggctacagccccgggctcggcggtcccggctggggaaggagggcggcgagcgcgtccggagccgccggagatggcgggagggcactgcggcagcttccccgcggcggcggccggcagcggcgagatcgtccaactgaacgtaggggggaccagatttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagagtgttttggctgggcacggtgggtcacgcctgtaatcccagcactttgggaggccgagatgggtggagttcaagatcagcccgaccaacatggtgaaaccccatctctactgaagatacaaaaattagccaggtgtggtgatgcatgcctgtaatcccagctactcgggaggctgaggcaggagaatcacttgacccaggaggtgggggttgcagtgagctgatagctcaccattgtactccaacctgcgcaacagagcaagactctgtct

SEQ ID NO: 305090 - DNA, 370 bp, Homo sapiens
ggaggagacagaaagtcatggtagctattcctctggaaatgacataggtgggttaggttattttagggcatttttaggtactatattaactgttcagaagaagcatatcaactaataaaaccacaaaaatgagttttaaatacaaattttccattttaattttgaaattctaaacagaattttagtgtgtttttctgattaaattctataaattcacaaaattattttattgcagcgtttttccttaaaatgttagagcaaatttttcctcttattaatgtttcatcatttaaagaatgtcatcttcacatgttaactacttttatttattattaaaactatgataactgtgtacatttgacatttgaaa

SEQ ID NO: 305091 - DNA, 449 bp, Homo sapiens
tttgccttctagacaatttatttgtactagcctgatagagccctaatctctcctttagtgacccaattcatatatatgtatatatatgaatggtttttaagtagataacagaatatttttgttcacatgcagtttttatttacactttttaatgattaaggataatagaaataaagagtattaggaggaaaataatttttaaagccttatgactatatacatgaagaacctagaattttttcctttcatgtcagatgataatacaggtttccagtgttagagaatttacatcatttgtttctttgtaggggagtgagtattaatgttctcaggcatgaagcagaattttacgggatcactccattaggtatgtgctcttttaatatttggtgtttatgatttgactcatgtatgaaagttgccctaaatgaaatgtgtttatatcaggt

SEQ ID NO: 305092 - DNA, 2733 bp, Homo sapiens
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305093 - DNA, 2672 bp, Homo sapiens
cccggtgttatttcatccaggggctgggcttcgttgttacgattagatggcctgttgggcgctacgactgtacaccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305094 - DNA, 2754 bp, Homo sapiens
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctctttgtgctggtctggaaaaaaact

SEQ ID NO: 305095 - DNA, 3334 bp, Homo sapiens
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctctttaaaaaaaaaaaaaacaaaaaaaaaaaaaaaaaaaaacaaaaaaaaaaaaaaaaaaaaaaaaaaaagagagggggggccgcgcgcacaagaagatatctccccgcgggggggcgcgccacaagtgccgcgcgcgccgcccgcgcgatatttgcgagcacaagaggggggccccactaaaagggagacgcgcctctcactaaatacgagcagacagacggaggtgcggagccgccagtttaacacacacgcgccgtgacaggggggcgacaaacagcggccgaaagctgggaaccacccatgtgaggaaagaacaccccataaacacgcggaggggggggagggaacccaccacatgggtggggacacacaaccacctccccctctaccgaaggaaatatatatctcacacggcccccctccgcgggcggcgaacactatcacaccaacccctctagcacacgacgggatctcgaccgcgcgggggggtcaacccccaactcccccgccatatcttgttgcccgcggggccagccaagcacagaaagtggtcggcgcccccaccgcggggggcttacatcacccacggacaacccatatcccg

SEQ ID NO: 305096 - DNA, 2485 bp, Homo sapiens
gatgaacgaggctgttcttttagattgggctctgtcacgggcagccctgaggttttctgcacgtatgtgtgctgagcccctgtctttctggtgttggcaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305097 - DNA, 2661 bp, Homo sapiens
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggagaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305098 - DNA, 2518 bp, Homo sapiens
tgcacatgtaggctaggtacgggcctggtgttaatcggccgacgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggagaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305099 - DNA, 2670 bp, Homo sapiens
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaaaagtaactgctgggacagtgccttgcacacagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305100 - DNA, 2324 bp, Homo sapiens
cacgagggctactggtaatgcacaacttcgacattaaaggtggctgaactctttgctaccattcattgctgacgggtcatggtccccccgaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305101 - DNA, 2761 bp, Homo sapiens
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggttcaaaggcccctgctgccccctgcaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305102 - DNA, 2347 bp, Homo sapiens
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305103 - DNA, 2519 bp, Homo sapiens
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305104 - DNA, 1775 bp, Homo sapiens
tccccacacctgtcatccacaccaagcattaactccccatcgccagctgatgactagttgcaccagctccacctctgatttgcctagtcggtcccccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305105 - DNA, 2319 bp, Homo sapiens
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcgtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305106 - DNA, 2547 bp, Homo sapiens
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305107 - DNA, 2153 bp, Homo sapiens
  misc_feature (2087)..(2087): n is a, c, g, or t
  misc_feature (2102)..(2102): n is a, c, g, or t
  misc_feature (2114)..(2114): n is a, c, g, or t
  misc_feature (2121)..(2121): n is a, c, g, or t
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgcggaatggcctttaaatcttcagctcccntcgggttccagagancacgtgtcaccnggtttgngcacaccgaatggggtgggccaagccggacct

SEQ ID NO: 305108 - DNA, 2245 bp, Homo sapiens
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaagctcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatctactcgagcaactat

SEQ ID NO: 305109 - DNA, 1571 bp, Homo sapiens
ggcacgagggttcctcagggaggtcaaatttactcaggaaccagctgcactaggctgttgttgatactgtcctctgcagatggttcctcagggaggtcaaatttactcaggtcacaccgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305110 - DNA, 1966 bp, Homo sapiens
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgagctcaccctctcttggtgcatttttttggaagaataaaattgcctctctcttt

SEQ ID NO: 305111 - DNA, 1772 bp, Homo sapiens
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305112 - DNA, 1901 bp, Homo sapiens
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtgagtgctgcagtgcccccaaccttcgccgtcctctccctcagcaacaccagaccatgggccttgggaccactggtggaacagtggggagggggcacccttggaataacactgaagactgttttaagaaagccctctcctttctggccaccacgatttatc

SEQ ID NO: 305113 - DNA, 1713 bp, Homo sapiens
  misc_feature (1610)..(1610): n is a, c, g, or t
  misc_feature (1625)..(1625): n is a, c, g, or t
  misc_feature (1630)..(1631): n is a, c, g, or t
  misc_feature (1641)..(1641): n is a, c, g, or t
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagttttgcctccngtttgactctggcancggcnntggggtgggncccctgattcctccgtgggcgaggggtccccctgcgcggaaccctcccaaattgttggcctgagttggaccc

SEQ ID NO: 305114 - DNA, 1093 bp, Homo sapiens
  misc_feature (32)..(33): n is a, c, g, or t
  misc_feature (70)..(70): n is a, c, g, or t
  misc_feature (72)..(72): n is a, c, g, or t
taaacttacggctaggtacgaggctgggtgtnncaccttctggctgcacactggggtggatgtcagcgangnggctctccagcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305115 - DNA, 1182 bp, Homo sapiens
tctacctgcttaaaatgacggttactgcacagggctgtgtgagggttacagtgcgtctctgggctgctcccagccatggcaggcccctgggaatcaaggtcatcagctgcttgtccaaggcagcagttagtggttgtgaatggtgcgtgtgagatctgcatcctggcgtcaggcctccttcctgccttacccaggacagcccagttgcagctgggttggtcccacagtcccacacacacacagcccgagtgtggtgcctcacgtgggctgccccgtgcctacccacagccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305116 - DNA, 1557 bp, Homo sapiens
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcgtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305117 - DNA, 768 bp, Homo sapiens
tcaggtatcaaagaagagtttgaaggggcagttgtcggcaaggatagagacttgggcagtgtggacatcatcagcttcacatcctcatccacaccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttt

SEQ ID NO: 305118 - DNA, 1243 bp, Homo sapiens
tgcacatgtaggctaggtacgggcctggtgttaatcggccgatgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagctcgcccctgagttaactcaggggcgagctgcgagccacagagatcaagccttctccaaaaattggactgcaaggcatgccgtacaaacagagtgctaggagaccttagggaggtggggaagaggaagaggaatcatggacagcttcatggggaggtggctttggagctgggatgggtgaggacagctggaatgtgggcagcacgtgaccaagtgctttgcagacatggcatggcccccagccaggccctgaggaaagggaagtctcagg

SEQ ID NO: 305119 - DNA, 564 bp, Homo sapiens
ctggtgctgcacggggcgggcagtgcatggccatgtctccttgtccagcgtcctacttacagttgaggaagcccacagccaggaagtgacttgtccagggtcacagggaatgtggagagagaataagaaggctctggcttctaggggagggaggcttataactctacccttccctggccaggatcaccagggtctgttgggaacacatagtccctgcctggatggtaaccctcttgcctcctcccagatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcgg

SEQ ID NO: 305120 - DNA, 773 bp, Homo sapiens
cagcgagtgaaggagggcagtcggcggctctcgcgccccggccactttccctgcgcgattcccggagctccctgcaggaggtgagagtccccagcgggtccggatggcgtagttttgccgcggcgcagcagctgccggagctcgccgccgccgagcgctgggcggggaaacttgccgccgctttcctccaacttgctgcgggtggatctccgctggacacaccgcctccgaggcagtttgaaaattgcaaggagggactttaagactacttctgatttgcaaagatggtctgtgctccgagcaggctaaagtgactggacgagacgcactgttggagaaataaaaatgacttcccattatgtgattgccatctttgccctgatgagcttctgtttagccactgcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcgggccaggggcctggccagctacagagagagcactctggcccccagaagcttctccacattgcccaggagctcctgcacaccgaggagacctatgtgaagcggatgaacctgctggaccaggttttctgcaccaggcttgacggatgcggggatccctccagaagtcattcatgggcatattctctaacaatctcctccatacagcgattcca

SEQ ID NO: 305121 - DNA, 291 bp, Homo sapiens
cggcacgaggcaatttctgaatgatgtaatctggacatcttttgtgctggttgatctttacaacaacatctccaaaagcccgagtgccctcttccattgacggccagtattctgcacacttgttcctgtttccttcttcacatcgagtgaccatgacaataactgtggctttctgttcagtgtgtcagctattttgtgaagatgcttagatgtatagttttgataaccacagttttaaatcttttatctgtgcataataaaaagatatatatcagttattaaaaaaaaaat

SEQ ID NO: 305122 - DNA, 6306 bp, Homo sapiens
tctttaagatttgtagctactaagaaagaaaggagctttttttccttgggccttcaaactgaaagaaccgcatgagcctgacggcgcatggtcttaacatcaggctgtgcaggaagaagctatctgcagatggatgccagcacacacaaggaagcagagctctggcaacattgagtcaaagcaaggacacaacatcagagggacggcagagaatccttgtgtgtagtctttggtggcagtttgaaaattgcaaggagggactttaagactacttctgatttgcaaagatggtctgtgctccgagcaggctaaagtgactggacgagacgcactgttggagaaataaaaatgacttcccattatgtgattgccatctttgccctgatgagcttctgtttagccactgcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcgggccaggggcctggccagctacagagagaggtcacacttcacctgaatcccatctcctcagtccacatccaccacaagtctgttgtgttcctgctcaactccccacaccccctggtgtggcatctgaagacagagagacttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcaccaagccccttgctgtgatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactctagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctccttgttaaaaaaaaaaaaaaaaaaaaagaatgccaggggggaattatcatgctaaattattttactgctgaagatagcttcattgcaaattattctttttccagaatttcccccaaacaacttagaattccataagtagaacaagatagattctacccccaaaatattcataagcaaatcccactgcccttaaaataaggaagttatgcctggttgtctgtgaatggaacctcagtaggtaatcctgatgaagcttaaaaccttagggcagtgtctacatgggaaacaagtatgtggaaattgacaatcatttttaccaaatcgttgagtaataatatgacttacctgatagatatacacattcaataaggaacatttttttttttcaataaggaacattttaactaaaacattactttagggctgagatttccaggctatctacattgatctactgaaaaatttctagatttccatatacaaacgaagaagacatgagtttagagaatttttttcctttaatttttttttaacagaagggtatcagagtggaggacctagattacgctacctgtgtttgaaaatattgcgctttgcctaaccttcggtggaatgtattgtttcagcatattctatgtataaaaaagtttaaagatgtcttcaaagaagactagagtctttaagtcacttatagctatattttactacaaaatttgtgtataaagatatatttaagtgttttagataaatttaagttactccatatgaaatgtttaatttcagctactgtgaattctttcgatcagtcctttgcttttttaaaaaatcttttccatcgtgttaaaaagaaaattagctattaggagatattaaaagattgatgtcttagaaggacagggttaaaaccttctgtaatatatttaaatatatatttttaagagagatgctacattgccaatgattttataaataatttaaaattaatttacaaatttatagatgcaaaccaaaagatctttttaaaagagagagagaggaaaaaaatcaccttttatttgtttgggtctcattgtcagaattattattcagatcaagaaatctgtgtcgataaaacctaatctcatattggagagtgaatgtcgttaagtatttctgaaatgtttctaaaaaatgaacatgaaaaaaataaggtattttctccctagcttctcattacagtatttctaattgcttcacactttacagttttaatacaaagtacaagctctacttttataacgtgtactacaagtttctttaaaagtattgttgtatttcagctgaactcttgtatctgcagtcttttgttatttctgcaggctacacccttaatttgcagaggccattttgttgtttgtttgatgctgaagctgttgttaaaatgccccaaactccaaggcagattgtctgtataatacgctatagcttttcaccatgtggtgtttaccagctgttactctgtattttaaaaagccagagatttcttctgtctaaactgtttctatagcattttctaaacaaaaaaaatggtttttttctttgccttgtaataagattgtaaatccatttcctgcttgtgttcttagtgggcatgattgtgagtgtgtgtggggtgctcacacgcgtgccagtctttttgtactgtaactacctcatggtttgaatgatgattgtactgctggttgtgttaacagagcacattttgttgggtgagtcctatgtgatttttttcatgtttgttttatctgggggttgttcatgaaactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaaatcttttatctgtgcataataaaaagatatatatcagttattaaaaaaaaaat

SEQ ID NO: 305123 - DNA, 6248 bp, Homo sapiens
tctttaagatttgtagctactaagaaagaaaggagctttttttccttgggccttcaaactgaaagaaccgcatgagcctgacggcgcatggtcttaacatcaggctgtgcaggaagaagctatctgcagatggatgccagcacacacaaggaagcagagctctggcaacattgagtcaaagcaaggacacaacatcagagggacggcagagaatccttgtgtgtagtctttggtggcagtttgaaaattgcaaggagggactttaagactacttctgatttgcaaagatggtctgtgctccgagcaggctaaagtgactggacgagacgcactgttggagaaataaaaatgacttcccattatgtgattgccatctttgccctgatgagcttctgtttagccactgcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcgggccaggggcctggccagctacagagagaggtcacacttcacctgaatcccatctcctcagtccacatccaccacaagtctgttgtgttcctgctcaactccccacaccccctggtgtggcatctgaagacagagagacttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcaccaagccccttgctgtgatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactctagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctccttgttaaaaaaaaaaaaaaaaaaaaagaatgccaggggggaattatcatgctaaattattttactgctgaagatagcttcattgcaaattattctttttccagaatttcccccaaacaacttagaattccataagtagaacaagatagattctacccccaaaatattcataagcaaatcccactgcccttaaaataaggaagttatgcctggttgtctgtgaatggaacctcagtaggtaatcctgatgaagcttaaaaccttagggcagtgtctacatgggaaacaagtatgtggaaattgacaatcatttttaccaaatcgttgagtaataatatgacttacctgatagatatacacattcaataaggaacatttttttttttcaataaggaacattttaactaaaacattactttagggctgagatttccaggctatctacattgatctactgaaaaatttctagatttccatatacaaacgaagaagacatgagtttagagaatttttttcctttaatttttttttaacagaagggtatcagagtggaggacctagattacgctacctgtgtttgaaaatattgcgctttgcctaaccttcggtggaatgtattgtttcagcatattctatgtataaaaaagtttaaagatgtcttcaaagaagactagagtctttaagtcacttatagctatattttactacaaaatttgtgtataaagatatatttaagtgttttagataaatttaagttactccatatgaaatgtttaatttcagctactgtgaattctttcgatcagtcctttgcttttttaaaaaatcttttccatcgtgttaaaaagaaaattagctattaggagatattaaaagattgatgtcttagaaggacagggttaaaaccttctgtaatatatttaaatatatatttttaagagagatgctacattgccaatgattttataaataatttaaaattaatttacaaatttatagatgcaaaccaaaagatctttttaaaagagagagagaggaaaaaaatcaccttttatttgtttgggtctcattgtcagaattattattcagatcaagaaatctgtgtcgataaaacctaatctcatattggagagtgaatgtcgttaagtatttctgaaatgtttctaaaaaatgaacatgaaaaaaataaggtattttctccctagcttctcattacagtatttctaattgcttcacactttacagttttaatacaaagtacaagctctacttttataacgtgtactacaagtttctttaaaagtattgttgtatttcagctgaactcttgtatctgcagtcttttgttatttctgcaggctacacccttaatttgcagaggccattttgttgtttgtttgatgctgaagctgttgttaaaatgccccaaactccaaggcagattgtctgtataatacgctatagcttttcaccatgtggtgtttaccagctgttactctgtattttaaaaagccagagatttcttctgtctaaactgtttctatagcattttctaaactgttcttagtgggcatgattgtgagtgtgtgtggggtgctcacacgcgtgccagtctttttgtactgtaactacctcatggtttgaatgatgattgtactgctggttgtgttaacagagcacattttgttgggtgagtcctatgtgatttttttcatgtttgttttatctgggggttgttcatgaaactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaaatcttttatctgtgcataataaaaagatatatatcagttattaaaaaaaaaat

SEQ ID NO: 305124 - DNA, 6303 bp, Homo sapiens
cagcgagtgaaggagggcagtcggcggctctcgcgccccggccactttccctgcgcgattcccggagctccctgcaggaggtgagagtccccagcgggtccggatggcgtagttttgccgcggcgcagcagctgccggagctcgccgccgccgagcgctgggcggggaaacttgccgccgctttcctccaacttgctgcgggtggatctccgctggacacaccgcctccgaggcagtttgaaaattgcaaggagggactttaagactacttctgatttgcaaagatggtctgtgctccgagcaggctaaagtgactggacgagacgcactgttggagaaataaaaatgacttcccattatgtgattgccatctttgccctgatgagcttctgtttagccactgcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcgggccaggggcctggccagctacagagagaggtcacacttcacctgaatcccatctcctcagtccacatccaccacaagtctgttgtgttcctgctcaactccccacaccccctggtgtggcatctgaagacagagagacttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcaccaagccccttgctgtgatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactctagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctccttgttaaaaaaaaaaaaaaaaaaaaagaatgccaggggggaattatcatgctaaattattttactgctgaagatagcttcattgcaaattattctttttccagaatttcccccaaacaacttagaattccataagtagaacaagatagattctacccccaaaatattcataagcaaatcccactgcccttaaaataaggaagttatgcctggttgtctgtgaatggaacctcagtaggtaatcctgatgaagcttaaaaccttagggcagtgtctacatgggaaacaagtatgtggaaattgacaatcatttttaccaaatcgttgagtaataatatgacttacctgatagatatacacattcaataaggaacatttttttttttcaataaggaacattttaactaaaacattactttagggctgagatttccaggctatctacattgatctactgaaaaatttctagatttccatatacaaacgaagaagacatgagtttagagaatttttttcctttaatttttttttaacagaagggtatcagagtggaggacctagattacgctacctgtgtttgaaaatattgcgctttgcctaaccttcggtggaatgtattgtttcagcatattctatgtataaaaaagtttaaagatgtcttcaaagaagactagagtctttaagtcacttatagctatattttactacaaaatttgtgtataaagatatatttaagtgttttagataaatttaagttactccatatgaaatgtttaatttcagctactgtgaattctttcgatcagtcctttgcttttttaaaaaatcttttccatcgtgttaaaaagaaaattagctattaggagatattaaaagattgatgtcttagaaggacagggttaaaaccttctgtaatatatttaaatatatatttttaagagagatgctacattgccaatgattttataaataatttaaaattaatttacaaatttatagatgcaaaccaaaagatctttttaaaagagagagagaggaaaaaaatcaccttttatttgtttgggtctcattgtcagaattattattcagatcaagaaatctgtgtcgataaaacctaatctcatattggagagtgaatgtcgttaagtatttctgaaatgtttctaaaaaatgaacatgaaaaaaataaggtattttctccctagcttctcattacagtatttctaattgcttcacactttacagttttaatacaaagtacaagctctacttttataacgtgtactacaagtttctttaaaagtattgttgtatttcagctgaactcttgtatctgcagtcttttgttatttctgcaggctacacccttaatttgcagaggccattttgttgtttgtttgatgctgaagctgttgttaaaatgccccaaactccaaggcagattgtctgtataatacgctatagcttttcaccatgtggtgtttaccagctgttactctgtattttaaaaagccagagatttcttctgtctaaactgtttctatagcattttctaaacaaaaaaaatggtttttttctttgccttgtaataagattgtaaatccatttcctgcttgtgttcttagtgggcatgattgtgagtgtgtgtggggtgctcacacgcgtgccagtctttttgtactgtaactacctcatggtttgaatgatgattgtactgctggttgtgttaacagagcacattttgttgggtgagtcctatgtgatttttttcatgtttgttttatctgggggttgttcatgaaactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaaatcttttatctgtgcataataaaaagatatatatcagttattaaaaaaaaaat

SEQ ID NO: 305125 - DNA, 6425 bp, Homo sapiens
gcgtggcaagtcaatacactgagataccaggttgcagcagagacagaggtttaattgtacagctgctgaactgggggaaaactcaaatccatctcccacaggagtttggggttggagtttttaagggttttgggtgggctgaaatatggagattgttgatgggtcgaagagtgcagggtaaagtcgtgggacagggggatgaagaaactgtgttctcatgctgatttggtggttcctttgtgggagtctttaaactggttggtgtcagctgtcccgttggaattcaggatctgctcatgcaactctcaaacaaaacccttaggattctaacatcagacatcctatctatctataggagcaatggggatgcaaatggtgagaatctagtgctatgtgacttggttacaagaaactaggtcaaagagcagcatgttaatgcttaattatattttctgtccggaattcttgttaacccagtgaggacagcttcaatctctgactgcacgtagcaggtggaatgattactccagtactcagattttgtgggaattgagttcctgctatgcttattttgtaaatcagcttctaatgatcactctagtgattctctttattatgcagtttgatacatcacagtactgatgcacaggccattctaacattctgttgttggtaaagacatatacatgtgagcatactggcttactaaacaggtcacacttcacctgaatcccatctcctcagtccacatccaccacaagtctgttgtgttcctgctcaactccccacaccccctggtgtggcatctgaagacagagagacttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcaccaagccccttgctgtgatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactctagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctccttgttaaaaaaaaaaaaaaaaaaaaagaatgccaggggggaattatcatgctaaattattttactgctgaagatagcttcattgcaaattattctttttccagaatttcccccaaacaacttagaattccataagtagaacaagatagattctacccccaaaatattcataagcaaatcccactgcccttaaaataaggaagttatgcctggttgtctgtgaatggaacctcagtaggtaatcctgatgaagcttaaaaccttagggcagtgtctacatgggaaacaagtatgtggaaattgacaatcatttttaccaaatcgttgagtaataatatgacttacctgatagatatacacattcaataaggaacatttttttttttcaataaggaacattttaactaaaacattactttagggctgagatttccaggctatctacattgatctactgaaaaatttctagatttccatatacaaacgaagaagacatgagtttagagaatttttttcctttaatttttttttaacagaagggtatcagagtggaggacctagattacgctacctgtgtttgaaaatattgcgctttgcctaaccttcggtggaatgtattgtttcagcatattctatgtataaaaaagtttaaagatgtcttcaaagaagactagagtctttaagtcacttatagctatattttactacaaaatttgtgtataaagatatatttaagtgttttagataaatttaagttactccatatgaaatgtttaatttcagctactgtgaattctttcgatcagtcctttgcttttttaaaaaatcttttccatcgtgttaaaaagaaaattagctattaggagatattaaaagattgatgtcttagaaggacagggttaaaaccttctgtaatatatttaaatatatatttttaagagagatgctacattgccaatgattttataaataatttaaaattaatttacaaatttatagatgcaaaccaaaagatctttttaaaagagagagagaggaaaaaaatcaccttttatttgtttgggtctcattgtcagaattattattcagatcaagaaatctgtgtcgataaaacctaatctcatattggagagtgaatgtcgttaagtatttctgaaatgtttctaaaaaatgaacatgaaaaaaataaggtattttctccctagcttctcattacagtatttctaattgcttcacactttacagttttaatacaaagtacaagctctacttttataacgtgtactacaagtttctttaaaagtattgttgtatttcagctgaactcttgtatctgcagtcttttgttatttctgcaggctacacccttaatttgcagaggccattttgttgtttgtttgatgctgaagctgttgttaaaatgccccaaactccaaggcagattgtctgtataatacgctatagcttttcaccatgtggtgtttaccagctgttactctgtattttaaaaagccagagatttcttctgtctaaactgtttctatagcattttctaaacaaaaaaaatggtttttttctttgccttgtaataagattgtaaatccatttcctgcttgtgttcttagtgggcatgattgtgagtgtgtgtggggtgctcacacgcgtgccagtctttttgtactgtaactacctcatggtttgaatgatgattgtactgctggttgtgttaacagagcacattttgttgggtgagtcctatgtgatttttttcatgtttgttttatctgggggttgttcatgaaactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaaatcttttatctgtgcataataaaaagatatatatcagttattaaaaaaaaaat

SEQ ID NO: 305126 - DNA, 5282 bp, Homo sapiens
ggagatagttgcaactttctggcatgtaggtcttaactttgcctttgtcttccattcacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcaccaagccccttgctgtgatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactctagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctccttgttaaaaaaaaaaaaaaaaaaaaagaatgccaggggggaattatcatgctaaattattttactgctgaagatagcttcattgcaaattattctttttccagaatttcccccaaacaacttagaattccataagtagaacaagatagattctacccccaaaatattcataagcaaatcccactgcccttaaaataaggaagttatgcctggttgtctgtgaatggaacctcagtaggtaatcctgatgaagcttaaaaccttagggcagtgtctacatgggaaacaagtatgtggaaattgacaatcatttttaccaaatcgttgagtaataatatgacttacctgatagatatacacattcaataaggaacatttttttttttcaataaggaacattttaactaaaacattactttagggctgagatttccaggctatctacattgatctactgaaaaatttctagatttccatatacaaacgaagaagacatgagtttagagaatttttttcctttaatttttttttaacagaagggtatcagagtggaggacctagattacgctacctgtgtttgaaaatattgcgctttgcctaaccttcggtggaatgtattgtttcagcatattctatgtataaaaaagtttaaagatgtcttcaaagaagactagagtctttaagtcacttatagctatattttactacaaaatttgtgtataaagatatatttaagtgttttagataaatttaagttactccatatgaaatgtttaatttcagctactgtgaattctttcgatcagtcctttgcttttttaaaaaatcttttccatcgtgttaaaaagaaaattagctattaggagatattaaaagattgatgtcttagaaggacagggttaaaaccttctgtaatatatttaaatatatatttttaagagagatgctacattgccaatgattttataaataatttaaaattaatttacaaatttatagatgcaaaccaaaagatctttttaaaagagagagagaggaaaaaaatcaccttttatttgtttgggtctcattgtcagaattattattcagatcaagaaatctgtgtcgataaaacctaatctcatattggagagtgaatgtcgttaagtatttctgaaatgtttctaaaaaatgaacatgaaaaaaataaggtattttctccctagcttctcattacagtatttctaattgcttcacactttacagttttaatacaaagtacaagctctacttttataacgtgtactacaagtttctttaaaagtattgttgtatttcagctgaactcttgtatctgcagtcttttgttatttctgcaggctacacccttaatttgcagaggccattttgttgtttgtttgatgctgaagctgttgttaaaatgccccaaactccaaggcagattgtctgtataatacgctatagcttttcaccatgtggtgtttaccagctgttactctgtattttaaaaagccagagatttcttctgtctaaactgtttctatagcattttctaaacaaaaaaaatggtttttttctttgccttgtaataagattgtaaatccatttcctgcttgtgttcttagtgggcatgattgtgagtgtgtgtggggtgctcacacgcgtgccagtctttttgtactgtaactacctcatggtttgaatgatgattgtactgctggttgtgttaacagagcacattttgttgggtgagtcctatgtgatttttttcatgtttgttttatctgggggttgttcatgaaactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaaatcttttatctgtgcataataaaaagatatatatcagttattaaaaaaaaaat

SEQ ID NO: 305127 - DNA, 1376 bp, Homo sapiens
cgcattggcagcgacactccgccagtttaacatttttacacattaccattaaaattgattcagtcttttatcatcctctacagtgaattctggacattatcaatcctgtaatcatttacctcccccccatcttgctattaggagatattaaaagattgatgtcttagaaggacagggttaaaaccttctgtaatatatttaaatatatatttttaagagagatgctacattgccaatgattttataaataatttaaaattaatttacaaatttatagatgcaaaccaaaagatctttttaaaagagagagagaggaaaaaaatcaccttttatttgtttgggtctcattgtcagaattattattcagatcaagaaatctgtgtcgataaaacctaatctcatattggagagtgaatgtcgttaagtatttctgaaatgtttctaaaaaatgaacatgaaaaaaataaggtattttctccctagcttctcattacagtatttctaattgcttcacactttacagttttaatacaaagtacaagctctacttttataacgtgtactacaagtttctttaaaagtattgttgtatttcagctgaactcttgtatctgcagtcttttgttatttctgcaggctacacccttaatttgcagaggccattttgttgtttgtttgatgctgaagctgttgttaaaatgccccaaactccaaggcagattgtctgtataatacgctatagcttttcaccatgtggtgtttaccagctgttactctgtattttaaaaagccagagatttcttctgtctaaactgtttctatagcattttctaaacaaaaaaaatggtttttttctttgccttgtaataagattgtaaatccatttcctgcttgtgttcttagtgggcatgattgtgagtgtgtgtggggtgctcacacgcgtgccagtctttttgtactgtaactacctcatggtttgaatgatgattgtactgctggttgtgttaacagagcacattttgttgggtgagtcctatgtgatttttttcatgtttgttttatctgggggttgttcatgaaactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaaatcttttatctgtgcataataaaaagatatatatcagttattaaaaaaaaaat

SEQ ID NO: 305128 - DNA, 2557 bp, Homo sapiens
gcgtggcaagtcaatacactgagataccaggttgcagcagagacagaggtttaattgtacagctgctgaactgggggaaaactcaaatccatctcccacaggagtttggggttggagtttttaagggttttgggtgggctgaaatatggagattgttgatgggtcgaagagtgcagggtaaagtcgtgggacagggggatgaagaaactgtgttctcatgctgatttggtggttcctttgtgggagtctttaaactggttggtgtcagctgtcccgttggaattcaggatctgctcatgcaactctcaaacaaaacccttaggattctaacatcagacatcctatctatctataggagcaatggggatgcaaatggtgagaatctagtgctatgtgacttggttacaagaaactaggtcaaagagcagcatgttaatgcttaattatattttctgtccggaattcttgttaacccagtgaggacagcttcaatctctgactgcacgtagcaggtggaatgattactccagtactcagattttgtgggaattgagttcctgctatgcttattttgtaaatcagcttctaatgatcactctagtgattctctttattatgcagtttgatacatcacagtactgatgcacaggccattctaacattctgttgttggtaaagacatatacatgtgagcatactggcttactaaacaggtcacacttcacctgaatcccatctcctcagtccacatccaccacaagtctgttgtgttcctgctcaactccccacaccccctggtgtggcatctgaagacagagagacttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaaatcttttatctgtgcataataaaaagatatatatcagttattaaaaaaaaaat

SEQ ID NO: 305129 - DNA, 342 bp, Homo sapiens
acttactcatcttgtatttgaatctaatggactaatatttgaaagaaataattcactgtcatcatctatatcaaattgaagtggaaaatatctttttctttcaatgtgtgtgtgttacttttgtaattagaaagaaggctataactatgttatgaagataaagcagcgtgtcatctgaagggctgtcttggcatatggtccttgtgcctaaagtgaaagtgagatgctaactcatttcctaattcatctttctgttctttcataggtatctgttactaaggctgaacaagaactgggatttgccatccaaacgtgctttatctctccatattcgaaccctga

SEQ ID NO: 305130 - DNA, 536 bp, Homo sapiens
agggagggcgagtgcgccgggtcgctctgatgggggtaatcgagggtttcggggacgccgagcggcactttcctcttcccagcgagtgaaggagggcagtcggcggctctcgcgccccggccactttccctgcgcgattcccggagctccctgcaggaggtgagagtccccagcgggtccggatggcgtagttttgccgcggcgcagcagctgccggagctcgccgccgccgagcgctgggcggggaaacttgccgccgctttcctccaacttgctgcgggtggatctccgctggacacaccgcctccgaggtacgtgccggcccagccccgcggcgctgcagcccgcccgggctgtgggctctgcaggctgcgcgggtgcccgtcggcgcggcgcgggctgccagtgcctacttaccggccagggtcgctccagccgccaggacctccggccttgggagggaggcgctggtggggcggtgtttaccctccggggagcaggcaccggtggccagcggtgcgtgggcagcggccgca

SEQ ID NO: 305131 - DNA, 505 bp, Homo sapiens
gaataatattagactacactggaaaagcatggtacttaaaggtattgaatttttttgtaagtaaataaaaagatatacacaaacacacacacaaattgtcggacccaaattccctaagtttaggtgtttgccttcaaattttcttcaaattggagagcctatgcaactgattgtcaacaaaatgcaatgcttaaaatttctgggtaactcattatagttttgatatctaaagaggatcattgacagagctttctcacagtatttattaccaaatggaaaagtgtcagtttctgctgagactttgatgaccctttgcttaaatcttggttctccatagaatacattgtgatttatgtttttgtttcagaaaaaggtccaagcatgaaggaaccaaatccaatttctccacgtaagtctttatgcaactatttcgaaataaaacctcctgggctttcctaagaatgagttggttagtgaacatttgccaaactttgagttttgataa

SEQ ID NO: 305132 - DNA, 5764 bp, Homo sapiens
agcggagggaaggaaggaaggaaggagaaaggaaaggaaggcaggagggagaaagatctaagtagcattgttaatttcttcaatttcttctaagggattttattgtttgttttagaagcttatcacagccttctttcatgattttgcagtttagacttgatacaaggaaaaattcagcttggggatggttaagagtgtttatagcagattctgacataggagagaaaacaaattctcatccaagaaggtagctagtaaaatatagggaaggtgagccatattcctatgcagcatcaatttattgacaatcaggtatttctcttaacagtttggtcttcttagttcaagaataaagggtatcatctttaataataagcattccccaaaaattgaagaggcagtcacacacttaagtgtgtggctttagaaaagcgcatgctaatttaaagatatacaggaagagaaaagtaggagttaagttggatgttgttagaagttggatgttagtattaccttcaggaacagatccccatggcatgtcacaggccttaattatatacctggctttcttattgtctccactttatcatgaggacaaggtcttggtttcatgggaggaacttctccattgaaataaatgtctgccatgtcagcaccgtttgttccctcagttttaatataatggaccatatattaaacataattaaacatatatttaaatgtggtgtttgcctgtgtctctagcaggatcttgaaattttaaaaatttgcttctggttcctgtttcagagaaaacattgtccccagaaatttcataggattgaaagtgttccctaagcagtgtgaacaatggaggaaaatatagtttagagaaaagtcagggaaaggtagggccagaggactgacaccaagaaatcattgaatctcaacataagacttcttggaatttagttaatcatattggaataaattccttcaagaatcttgtcccttggtaatcaaagtttgaaaccccgcactgaaaagcaccaactggttggaaataatatactgagaggagtgaaattcatcaattaatctgagtggctaatatatttaatatcctttgtatacaaagtaaaactccaccattcgtaaaaggaaatccttagacccaactttcagttaacaaaaacagaaatgactttgacccagggtgcttcctgaagaatgagaactatccagggctttacaactgcagaattgtaattatgctctgtgcaattgttgagcaaaggttttgccttgctggataaaaagtcttgtttgtttcgagacatgaaatccccatgtcttaaaagaactaaggcttatagaaaagcagatgggttttctctcaggaaggactgccccattgacctttgccttctcttccaagtcagacagacttctcgcttgccatgggcatttttttactacatagtcagactactggggctacttatagagaccttgtaaaagtactcgtgattttcacgttcttggaggaccaaacaaaaatctgtttctcctccaaaaatggacttacctcctttgcacacaaaagctaaactcctcagcatgaaattgtttgagttattactttaccaagttgtgagcttcttgaatcctccagagtcgcagattccatccctgagttggttgtggtttcactgtttctattggctattctccctgaatttttcattttgttctttgcagggctcgaattatttgtggaaaacaataatatatatgtgtgtgtattttttatctttatagatgctatatttacaataatgtatgtattataagacaaattaagaataatgttttgatcttaaaaggaagaaaagtactgaatttggttgtttagaaagaaaatctatgctcacgtagaaagacatagagccccactttttccgttttgtaattatttggcgaaaagaaatttgcttatagactatgtttaatgggattaaccatgtcctcatttttcttttcatcctcatacacttttagcctgcatttagtcttggttaccaatatcattttttaagagaaatgtaagtacagtgctatatcttacctacataaactattaatattttgaagacaaatgtgaaacacaccacaaaaatggtgagataagaaacaaaaatgcagtttaggaagcctcctccttgcttaaatgtttagaatatttcttctccaaagactgcatttgcctcagtgatgtaaattttccatcatggttggcataatatctgtaaacatctcactaaatgcaaaatggagtttacatttatgtgcatactagcagaaaagaagtaaactattctcatttgcatgtagctatgctgttcaaatgtcgccaaccaaaatttaggaaagaatttgttttcacccagcatgtacatctcacttttctcttggcaaggaagctggtgttaacgttgggtttaggtttaacatttacaccagcgaaaatgtttatgaatattatggaaaacttattttaaaccttgatttcttttgagcacatttacatgctgcgtgctgattaataaattaggcaccaatcatgtgtaaatcaatgtaaatcactagtttatgtacataatataaactatgtaaacttcatttttcatgcagtgcccaactactgctaaggtttactatgattcttaaggaaaaaaaaatcaaataaaaataaataaaaactgaaacgtttcacagttcagaatcggaagaattacgactaaagctccaaatatgaggttgccttagccaaaggaagcagacccacaggaacagttcaaggtttatatcctgctcaagtcacctctttggtctttcaggatctaagtggagattgtcccaactgttgctgtagttgtctcacccgaccccaaagcaagggaaatagagggaaaggttttaagggctatatgtctgctgtatccactcccagctatcttctttttactcctttctcaccatctaagatgtcttatttaaatagctccaaggaagtgacctaaaccttgatgagcaaaatattactcagtttttattttccattcaacaaaagcagtgggaaagcttgccatctggattctaagaaattgtgcaatataaaaaaatgttatatcctcgagaaatatcttgctgagtcaccctaggaaataactaccttttatttatctggtagcctaatgtttccacacatttatcctgaatattgcaagtgagggactgaatcatttttaattgggagttatctttctcaggcatgttctcttggagtctttttgaagtgcctgacacgtgtaacaggatgacatatatatcattcctacaatatgaacaactgttacataaaaaattatcaaggagatgatttcaggaaacaagtgaactttctgcaaagacttataaaaattttaggtcaaattaacttcaggctttaaatgcactaatctacctaagagaaaaaaaaagaaaaaaaacaggaaggagttttaagggctcatgtgcctgttgtatcaacccccaagtgtcttcttggtactgcttcctcatcatctaagataaactgacaactttaaagtgaggtagaaggtgtattgaattgggagtcaggagaattgggttctaaccccaagttcagccacaaataaagctgtgagacattggcaagtcatttaactttcctgagtcttggttttctcatcctgaaagtgagggattcggctgacgtctctaaaatctctttcaactctaacctttattctgaataagaatttaatattcacttagtgctgtgcccagcactgtttgtaaacagcagctgtttgttatctctagtttggtctctgtattctcatcacttctcagaactatcattctaccgtcttcatttctaaacccaaaactgctagaatacagggactctggactgggtctgtaaattttttctgatcaaaactttatagcagtgtagagaagggacacattcaaattacactaaggacattgacatagctggggttgtttccttgtttatattataaaacctaaatgtggaactatattctaataatctttcataggaaggaaaatagccagactgggtattatgcatgtaacaaatgaggacattgtgcataagaaaggaaacattagttttctgtcatcctgggccaagtacctcattacagtaaatgtgtgtctttggaaactctttgcttgtgctgatggcggtaagcatggggtcccaggcaggttcaaaggctgaactgtaagaaatgggcaagacaatacattttgttttggaaggaatttctcatgggataagtttcccaaagcttgaattataggctatgaaataaagcaaatagatggagagaaaacaagtattgttttcaaaaagtacaagtcaattctatttaaagaagacaagctgaaaattaaaacaaaaattaaacacaatttagggaggttacaggagttgaaggacagtatgaattgttgtgaaggccaaaatcaaatgtgaaagttaggttctctgagaaaagggtaagcagaaaggatgatttctcaagcaattaataaggaattattttcttgtgccatgttctagatgcattgagcacagatcctcttgtcctaagctgtcctagaggctcaggttagcatctatccaaagttgtcctttgattttattgtctgaaagaacagaaggcatcagagtttccagtcactgaagagtagggtttgttcatcacttcccagcaatcacatcactttgtgtaggtaaggatatatgatgtgcttagattacttatgaagctctctctaagtgggagaatgacctgtccatgggacaactccccgttttcatggtcatttcagaagtacctctttttgggcagtgctcctggatctacttctacagccacattctactctgcacaatcctccctatgtaaagccaggcacagtacaaatatgcttcttgcaagtgaagaaaacccatggaagtcctagcttcatggcacgctgcagcaatcccaagctaccaggagcctcttttgaacccacttcccctaagtctttgctcttcaccagagaatggaaattgttcatcctggtgaactgtggccaagttctgctccctaagtatttacttggagtagggaggttaaagggaagaaattcagggggagagaagcaaaagagaacacttccaactccctcccccatctcccaatgctccccaccttccttatcactgctctactgaagggtgtataaatcctgctcttggttagaattctccttattaacagtgttatatacatataaatatatatataaatatattccttttttcagccctgtagacatgaactgatcttcccttgaagatacaaacacatggccattttttgtttgggattttttgtttttcaaggtttttcatttttgtttattaggtggatttttttccctgggtactagctctgtgaaggagataaaaagcgcaatgtgtgttaaaaaaaaaaaattaaaattaaaatgaaaaaaagctttttttcttttctttttaaatgtatttaaattctgtttctctcttctgttactttacacgtatgaatgctctgctcttctgtgatcttaaaacaaaatgaaataaacgtgaaaaggagatgtgtcttcattgacctgtcagtgatcttgt

SEQ ID NO: 305133 - DNA, 5580 bp, Homo sapiens
agcggagggaaggaaggaaggaaggagaaaggaaaggaaggcaggagggagaaagatctaagtagcattgttaatttcttcaatttcttctaagggattttattgtttgttttagaagcttatcacagccttctttcatgattttgcagtttagacttgatacaaggaaaaattcagcttggggatggttaagagtgtttatagcagattctgacataggagagaaaacaaattctcatccaagaaggtagctagtaaaatatagggaaggtgagccatattcctatgcagcatcaatttattgacaatcaggtatttctcttaacagtttggtcttcttagttcaagaataaagggtatcatctttaataataagcattccccaaaaattgaagaggcagtcacacacttaagtgtgtggctttagaaaagcgcatgctaatttaaagatatacaggaagagaaaagtaggagttaagttggatgttgttagaagttggatgttagtattaccttcaggaacagatccccatggcatgtcacaggccttaattatatacctggctttcttattgtctccactttatcatgaggacaaggtcttggtttcatgggaggaacttctccattgaaataaatgtctgccatgtcagcaccgtttgttccctcagttttaatataatggaccatatattaaacataattaaacatatatttaaatgtggtgtttgcctgtgtctctagcaggatcttgaaattttaaaaatttgcttctggttcctgtttcagagaaaacattgtccccagaaatttcataggattgaaagtgttccctaagcagtgtgaacaatggaggaaaatatagtttagagaaaagtcagggaaaggtagggccagaggactgacaccaagaaatcattgaatctcaacataagacttcttggaatttagttaatcatattggaataaattccttcaagaatcttgtcccttggtaatcaaagtttgaaaccccgcactgaaaagcaccaactggttggaaataatatactgagaggagtgaaattcatcaattaatctgagtggctaatatatttaatatcctttgtatacaaagtaaaactccaccattcgtaaaaggaaatccttagacccaactttcagttaacaaaaacagaaatgactttgacccagggtgcttcctgaagaatgagaactatccagggctttacaactgcagaattgtaattatgctctgtgcaattgttgagcaaaggttttgccttgctggataaaaagtcttgtttgtttcgagacatgaaatccccatgtcttaaaagaactaaggcttatagaaaagcagatgggttttctctcaggaaggactgccccattgacctttgccttctcttccaagtcagacagacttctcgcttgccatgggcatttttttactacatagtcagactactggggctacttatagagaccttgtaaaagtactcgtgattttcacgttcttggaggaccaaacaaaaatctgtttctcctccaaaaatggacttacctcctttgcacacaaaagctaaactcctcagcatgaaattgtttgagttattactttaccaagttgtgagcttcttgaatcctccagagtcgcagattccatccctgagttggttgtggtttcactgtttctattggctattctccctgaatttttcattttgttctttgcagggctcgaattatttgtggaaaacaataatatatatgtgtgtgtattttttatctttatagatgctatatttacaataatgtatgtattataagacaaattaagaataatgttttgatcttaaaaggaagaaaagtactgaatttggttgtttagaaagaaaatctatgctcacgtagaaagacatagagccccactttttccgttttgtaattatttggcgaaaagaaatttgcttatagactatgtttaatgggattaaccatgtcctcatttttcttttcatcctcatacacttttagcctgcatttagtcttggttaccaatatcattttttaagagaaatgtaagtacagtgctatatcttacctacataaactattaatattttgaagacaaatgtgaaacacaccacaaaaatggtgagataagaaacaaaaatgcagtttaggaagcctcctccttgcttaaatgtttagaatatttcttctccaaagactgcatttgcctcagtgatgtaaattttccatcatggttggcataatatctgtaaacatctcactaaatgcaaaatggagtttacatttatgtgcatactagcagaaaagaagtaaactattctcatttgcatgtagctatgctgttcaaatgtcgccaaccaaaatttaggaaagaatttgttttcacccagcatgtacatctcacttttctcttggcaaggaagctggtgttaacgttgggtttaggtttaacatttacaccagcgaaaatgtttatgaatattatggaaaacttattttaaaccttgatttcttttgagcacatttacatgctgcgtgctgattaataaattaggcaccaatcatgtgtaaatcaatgtaaatcactagtttatgtacataatataaactatgtaaacttcatttttcatgcagtgcccaactactgctaaggtttactatgattcttaaggaaaaaaaaatcaaataaaaataaataaaaactgaaacgtttcacagttcagaatcggaagaattacgactaaagctccaaatatgaggttgccttagccaaaggaagcagacccacaggaacagttcaaggtttatatcctgctcaagtcacctctttggtctttcaggatctaagtggagattgtcccaactgttgctgtagttgtctcacccgaccccaaagcaagggaaatagagggaaaggttttaagggctatatgtctgctgtatccactcccagctatcttctttttactcctttctcaccatctaagatgtcttatttaaatagctccaaggaagtgacctaaaccttgatgagcaaaatattactcagtttttattttccattcaacaaaagcagtgggaaagcttgccatctggattctaagaaattgtgcaatataaaaaaatgttatatcctcgagaaatatcttgctgagtcaccctaggaaataactaccttttatttatctggtagcctaatgtttccacacatttatcctgaatattgcaagtgagggactgaatcatttttaattgggagttatctttctcaggcatgttctcttggagtctttttgaagtgcctgacacgtgtaacaggatgacatatatatcattcctacaatatgaacaactgttacataaaaaattatcaaggagatgatttcaggaaacaagtgaactttctgcaaagacttataaaaattttaggtcaaattaacttcaggctttaaatgcactaatctacctaagagaaaaaaaaagaaaaaaaacaggaaggagttttaagggctcatgtgcctgttgtatcaacccccaagtgtcttcttggtactgcttcctcatcatctaagataaactgacaactttaaagtgaggtagaaggtgtattgaattgggagtcaggagaattgggttctaaccccaagttcagccacaaataaagctgtgagacattggcaagtcatttaactttcctgagtcttggttttctcatcctgaaagtgagggattcggctgacgtctctaaaatctctttcaactctaacctttattctgaataagaatttaatattcacttagtgctgtgcccagcactgtttgtaaacagcagctgtttgttatctctagtttggtctctgtattctcatcacttctcagaactatcattctaccgtcttcatttctaaacccaaaactgctagaatacagggactctggactgggtctgtaaattttttctgatcaaaactttatagcagtgtagagaagggacacattcaaattacactaaggacattgacatagctggggttgtttccttgtttatattataaaacctaaatgtggaactatattctaataatctttcataggaaggaaaatagccagactgggtattatgcatgtaacaaatgaggacattgtgcataagaaaggaaacattagttttctgtcatcctgggccaagtacctcattacagtaaatgtgtgtctttggaaactctttgcttgtgctgatggcggtaagcatggggtcccaggcaggttcaaaggctgaactgtaagaaatgggcaagacaatacattttgttttggaaggaatttctcatgggataagtttcccaaagcttgaattataggctatgaaataaagcaaatagatggagagaaaacaagtattgttttcaaaaagtacaagtcaattctatttaaagaagacaagctgaaaattaaaacaaaaattaaacacaatttagggaggttacaggagttgaaggacagtatgaattgttgtgaaggccaaaatcaaatgtgaaagttaggttctctgagaaaagggtaagcagaaaggatgatttctcaagcaattaataaggaattattttcttgtgccatgttctagatgcattgagcacagatcctcttgtcctaagctgtcctagaggctcaggttagcatctatccaaagttgtcctttgattttattgtctgaaagaacagaaggcatcagagtttccagtcactgaagagtagggtttgttcatcacttcccagcaatcacatcactttgtgtaggtaaggatatatgatgtgcttagattacttatgaagctctctctaagtgggagaatgacctgtccatgggacaactccccgttttcatggtcatttcagaagtacctctttttgggcagtgctcctggatctacttctacagccacattctactctgcacaatcctccctatgtaaagccaggcacagtacaaatatgcttcttgcaagtgaagaaaacccatggaagtcctagcttcatggcacgctgcagcaatcccaagctaccaggagcctcttttgaacccacttcccctaagtctttgctcttcaccagagaatggaaattgttcatcctggtgaactgtggccaagttctgctccctaagtatttacttggagtagggaggttaaagggaagaaattcagggggagagaagcaaaagagaacacttccaactccctcccccatctcccaatgctccccaccttccttatcactgctctactgaagggtgtataaatcctgctcttggttagaattctccttattaacagtgttatatacatataaatatatatataaatatattccttttttcagccctgtagacatgaactgatcttcccttgaagatacaaacacatggccattttttgtttgggattttttgtttttcaaggtttttcatttttgtttattaggtggatttttttccctgggtactagctctgtgaaggagataaaaagcgcaatgtgtgttaa

SEQ ID NO: 305134 - DNA, 3067 bp, Homo sapiens
cccatggaatccccccaggaatcccaaataaaaataaataaaaactgaaacgtttcacagttcagaatcggaagaattacgactaaagctccaaatatgaggttgccttagccaaaggaagcagacccacaggaacagttcaaggtttatatcctgctcaagtcacctctttggtctttcaggatctaagtggagattgtcccaactgttgctgtagttgtctcacccgaccccaaagcaagggaaatagagggaaaggttttaagggctatatgtctgctgtatccactcccagctatcttctttttactcctttctcaccatctaagatgtcttatttaaatagctccaaggaagtgacctaaaccttgatgagcaaaatattactcagtttttattttccattcaacaaaagcagtgggaaagcttgccatctggattctaagaaattgtgcaatataaaaaaatgttatatcctcgagaaatatcttgctgagtcaccctaggaaataactaccttttatttatctggtagcctaatgtttccacacatttatcctgaatattgcaagtgagggactgaatcatttttaattgggagttatctttctcaggcatgttctcttggagtctttttgaagtgcctgacacgtgtaacaggatgacatatatatcattcctacaatatgaacaactgttacataaaaaattatcaaggagatgatttcaggaaacaagtgaactttctgcaaagacttataaaaattttaggtcaaattaacttcaggctttaaatgcactaatctacctaagagaaaaaaaaagaaaaaaaacaggaaggagttttaagggctcatgtgcctgttgtatcaacccccaagtgtcttcttggtactgcttcctcatcatctaagataaactgacaactttaaagtgaggtagaaggtgtattgaattgggagtcaggagaattgggttctaaccccaagttcagccacaaataaagctgtgagacattggcaagtcatttaactttcctgagtcttggttttctcatcctgaaagtgagggattcggctgacgtctctaaaatctctttcaactctaacctttattctgaataagaatttaatattcacttagtgctgtgcccagcactgtttgtaaacagcagctgtttgttatctctagtttggtctctgtattctcatcacttctcagaactatcattctaccgtcttcatttctaaacccaaaactgctagaatacagggactctggactgggtctgtaaattttttctgatcaaaactttatagcagtgtagagaagggacacattcaaattacactaaggacattgacatagctggggttgtttccttgtttatattataaaacctaaatgtggaactatattctaataatctttcataggaaggaaaatagccagactgggtattatgcatgtaacaaatgaggacattgtgcataagaaaggaaacattagttttctgtcatcctgggccaagtacctcattacagtaaatgtgtgtctttggaaactctttgcttgtgctgatggcggtaagcatggggtcccaggcaggttcaaaggctgaactgtaagaaatgggcaagacaatacattttgttttggaaggaatttctcatgggataagtttcccaaagcttgaattataggctatgaaataaagcaaatagatggagagaaaacaagtattgttttcaaaaagtacaagtcaattctatttaaagaagacaagctgaaaattaaaacaaaaattaaacacaatttagggaggttacaggagttgaaggacagtatgaattgttgtgaaggccaaaatcaaatgtgaaagttaggttctctgagaaaagggtaagcagaaaggatgatttctcaagcaattaataaggaattattttcttgtgccatgttctagatgcattgagcacagatcctcttgtcctaagctgtcctagaggctcaggttagcatctatccaaagttgtcctttgattttattgtctgaaagaacagaaggcatcagagtttccagtcactgaagagtagggtttgttcatcacttcccagcaatcacatcactttgtgtaggtaaggatatatgatgtgcttagattacttatgaagctctctctaagtgggagaatgacctgtccatgggacaactccccgttttcatggtcatttcagaagtacctctttttgggcagtgctcctggatctacttctacagccacattctactctgcacaatcctccctatgtaaagccaggcacagtacaaatatgcttcttgcaagtgaagaaaacccatggaagtcctagcttcatggcacgctgcagcaatcccaagctaccaggagcctcttttgaacccacttcccctaagtctttgctcttcaccagagaatggaaattgttcatcctggtgaactgtggccaagttctgctccctaagtatttacttggagtagggaggttaaagggaagaaattcagggggagagaagcaaaagagaacacttccaactccctcccccatctcccaatgctccccaccttccttatcactgctctactgaagggtgtataaatcctgctcttggttagaattctccttattaacagtgttatatacatataaatatatatataaatatattccttttttcagccctgtagacatgaactgatcttcccttgaagatacaaacacatggccattttttgtttgggattttttgtttttcaaggtttttcatttttgtttattaggtggatttttttccctgggtactagctctgtgaaggagataaaaagcgcaatgtgtgttaaaaaaaaaaaattaaaattaaaatgaaaaaaagctttttttcttttctttttaaatgtatttaaattctgtttctctcttctgttactttacacgtatgaatgctctgctcttctgtgatcttaaaacaaaatgaaataaacgtgaaaaggagatgtgtcttcattgacctgtcagtgatcttgt

SEQ ID NO: 305135 - DNA, 2681 bp, Homo sapiens
cgggtccggaattcccgggtggactactaatactactaaattcgcggccgcgtcgacaagaaattgtgcaatataaaaaaatgttatatcctcgagaaatatcttgctgagtcaccctaggaaataactaccttttatttatctggtagcctaatgtttccacacatttatcctgaatattgcaagtgagggactgaatcatttttaattgggagttatctttctcaggcatgttctcttggagtctttttgaagtgcctgacacgtgtaacaggatgacatatatatcattcctacaatatgaacaactgttacataaaaaattatcaaggagatgatttcaggaaacaagtgaactttctgcaaagacttataaaaattttaggtcaaattaacttcaggctttaaatgcactaatctacctaagagaaaaaaaaagaaaaaaaacaggaaggagttttaagggctcatgtgcctgttgtatcaacccccaagtgtcttcttggtactgcttcctcatcatctaagataaactgacaactttaaagtgaggtagaaggtgtattgaattgggagtcaggagaattgggttctaaccccaagttcagccacaaataaagctgtgagacattggcaagtcatttaactttcctgagtcttggttttctcatcctgaaagtgagggattcggctgacgtctctaaaatctctttcaactctaacctttattctgaataagaatttaatattcacttagtgctgtgcccagcactgtttgtaaacagcagctgtttgttatctctagtttggtctctgtattctcatcacttctcagaactatcattctaccgtcttcatttctaaacccaaaactgctagaatacagggactctggactgggtctgtaaattttttctgatcaaaactttatagcagtgtagagaagggacacattcaaattacactaaggacattgacatagctggggttgtttccttgtttatattataaaacctaaatgtggaactatattctaataatctttcataggaaggaaaatagccagactgggtattatgcatgtaacaaatgaggacattgtgcataagaaaggaaacattagttttctgtcatcctgggccaagtacctcattacagtaaatgtgtgtctttggaaactctttgcttgtgctgatggcggtaagcatggggtcccaggcaggttcaaaggctgaactgtaagaaatgggcaagacaatacattttgttttggaaggaatttctcatgggataagtttcccaaagcttgaattataggctatgaaataaagcaaatagatggagagaaaacaagtattgttttcaaaaagtacaagtcaattctatttaaagaagacaagctgaaaattaaaacaaaaattaaacacaatttagggaggttacaggagttgaaggacagtatgaattgttgtgaaggccaaaatcaaatgtgaaagttaggttctctgagaaaagggtaagcagaaaggatgatttctcaagcaattaataaggaattattttcttgtgccatgttctagatgcattgagcacagatcctcttgtcctaagctgtcctagaggctcaggttagcatctatccaaagttgtcctttgattttattgtctgaaagaacagaaggcatcagagtttccagtcactgaagagtagggtttgttcatcacttcccagcaatcacatcactttgtgtaggtaaggatatatgatgtgcttagattacttatgaagctctctctaagtgggagaatgacctgtccatgggacaactccccgttttcatggtcatttcagaagtacctctttttgggcagtgctcctggatctacttctacagccacattctactctgcacaatcctccctatgtaaagccaggcacagtacaaatatgcttcttgcaagtgaagaaaacccatggaagtcctagcttcatggcacgctgcagcaatcccaagctaccaggagcctcttttgaacccacttcccctaagtctttgctcttcaccagagaatggaaattgttcatcctggtgaactgtggccaagttctgctccctaagtatttacttggagtagggaggttaaagggaagaaattcagggggagagaagcaaaagagaacacttccaactccctcccccatctcccaatgctccccaccttccttatcactgctctactgaagggtgtataaatcctgctcttggttagaattctccttattaacagtgttatatacatataaatatatatataaatatattccttttttcagccctgtagacatgaactgatcttcccttgaagatacaaacacatggccattttttgtttgggattttttgtttttcaaggtttttcatttttgtttattaggtggatttttttccctgggtactagctctgtgaaggagataaaaagcgcaatgtgtgttaaaaaaaaaaaattaaaattaaaatgaaaaaaagctttttttcttttctttttaaatgtatttaaattctgtttctctcttctgttactttacacgtatgaatgctctgctcttctgtgatcttaaaacaaaatgaaataaacgtgaaaaggagatgtgtcttcattgacctgtcagtgatcttgt

SEQ ID NO: 305136 - DNA, 371 bp, Homo sapiens
tgaacatggaggtagttgccaatttttactgattataaataatgcagtaaactcatacttgtacttttgtgggaacatctctgattattttctgaagttaattcctagaaatagcatatgcacatttttgaaccttttgtacatattgccaaattgtcctccagaaagatcatgccaatttagagtttcatagcagtatacgggaccattccctgccagtattgtgtattattcttttctgatttttggcgattgctattttaatttgcatttttttcattactattgagattgaatttcttttttactaagaatatttctcatttctgtttctccttttgtaaattggctgttcatgttgttggcacttt

SEQ ID NO: 305137 - DNA, 333 bp, Homo sapiens
acattgcagccaacacctgccagcagtggacacagtcagtaatttgttgaatgaacaaattttcagcgaacaggttcatttatacctcttcctctgcttttaacacgtttttgaactgttcatctttgctaaccattccagtctaccagggaagaagtttggaggagaaagcaaagaaggaagggaactcacaatggttgagcacgtgttatacactaggcatgattctaggctcttatcactacctatttcatttcatcctcaaaataatcctatgtgtccggttattattactcccattttacagttaggaaactagggcacataacttat

SEQ ID NO: 305138 - DNA, 2295 bp, Homo sapiens
cccattttggacttgtgacctccgggacgagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaatgatacatgaatcttggccacaatgagaaaaataaaaatgaaaaaagagcaggcatccatttccatacaggaacaaaataggaggcagcactacagaccctacacacagctttacagaggtgaaagaaaactgtcagcaattctatgctgacataacagaaaatgtagatgagatagatgaaatacgaaaaattacagtttacttaatgaacataaggataaatagaaaaactgaatcatcatacataaacatatataaaatgcattgatcctgtaatcaaaaatgttcccacaaagtaaatgccacttcagcaaggaaa

SEQ ID NO: 305139 - DNA, 2071 bp, Homo sapiens
ggctggtacggcccggaagtatgggatccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaatgatacatgaatcttggccacaatgagaaaaataaaaatgaaaaaagagcaggcatccatttccatacaggaacaaaataggaggcagcactacagaccctacacacagctttacagaggtgaaagaaaactgtcagcaattctatgctgacataacagaaaatgtagatgagatagatgaaatacgaaaaattacagtttacttaatgaacataaggataaatagaaaaactgaatcatcatacataaacatatataaaatgcattgatcctgtaatcaaaaatgttcccacaaagtaaatgccacttcagcaaggaaa

SEQ ID NO: 305140 - DNA, 3087 bp, Homo sapiens
cccattttggacttgtgacctccgggacgagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcatcgtcacggtggacccctccttgtccagcacgctgcctcctgcctgctgggacctcactctctcctgctgtcctgggacctcatgggcctcctcccgggtccccttcctgctcctcatcctctgtttggccatctggttgttagagagctccccaggcctcaggaggatgacgaataaatgaaccactccagtcccctgggctccccttcattcattcatctagtgagtgttcccagggagctcactgtggatggggctccccatgggagctgcagacacagcagggagcaaagccgcccccgcctcctgagctcacctcgtggtgggagacaaaatgcaaataaatgcatcgtgtccaggagtgcaacgtgctgtaaggaacataaaccaggtaaagggcagagagtgtggggcagtggggccagtctgaatggaaagggagggctgtctgctcagctgtcatctgagaagcctggacggagagggccacgtgatcctctaatggacgagcccctgcaggcagaggaaacagccgtgcaaaggccccgaggcagcagcgagctcttgcaggaaggccgcgtgaggctgcagccaaatgggcaaggtcagagtgaggagcagaggccagaaccacagggagggagcggccagaccctccacggccttagggcgtccctgagattccgtcaggaaagggatgtaatcggatcaccctgggaacagtggggaaaattgactccagggagtcaggaggattcaaggacaccccccaccactgtctctctccagcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaatgatacatgaatcttggccacaatgagaaaaataaaaatgaaaaaagagcaggcatccatttccatacaggaacaaaataggaggcagcactacagaccctacacacagctttacagaggtgaaagaaaactgtcagcaattctatgctgacataacagaaaatgtagatgagatagatgaaatacgaaaaattacagtttacttaatgaacataaggataaatagaaaaactgaatcatcatacataaacatatataaaatgcattgatcctgtaatcaaaaatgttcccacaaagtaaatgccacttcagcaaggaaa

SEQ ID NO: 305141 - DNA, 2219 bp, Homo sapiens
agagatgtccacctcctgaggcccagaccctcccaggagacccattttggacttgtgacctccgggacgagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaatgatacatgaatcttggccacaatgagaaaaataaaaatgaaaaaagagcaggcatccatttccatacaggaacaaaataggaggcagcactacagaccctacacacagctttacagaggtgaaagaaaactgtcagcaattctatgctgacataacagaaaatgtagatgagatagatgaaatacgaaaaattacagtttacttaatgaacataaggataaatagaaaaactgaatcatcatacataaacatatataaaatgcattgatcctgtaatcaaaaatgttcccacaaagtaaatgccacttcagcaaggaaa

SEQ ID NO: 305142 - DNA, 3180 bp, Homo sapiens
cccattttggacttgtgacctccgggacgagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcgggtgagaacccgcccctgtccccggcaccaaaggcctcctggtgccagatctaatcctgcaggacttctctgtcctccttcccccggctctcagcatcgtcacggtggacccctccttgtccagcacgctgcctcctgcctgctgggacctcactctctcctgctgtcctgggacctcatgggcctcctcccgggtccccttcctgctcctcatcctctgtttggccatctggttgttagagagctccccaggcctcaggaggatgacgaataaatgaaccactccagtcccctgggctccccttcattcattcatctagtgagtgttcccagggagctcactgtggatggggctccccatgggagctgcagacacagcagggagcaaagccgcccccgcctcctgagctcacctcgtggtgggagacaaaatgcaaataaatgcatcgtgtccaggagtgcaacgtgctgtaaggaacataaaccaggtaaagggcagagagtgtggggcagtggggccagtctgaatggaaagggagggctgtctgctcagctgtcatctgagaagcctggacggagagggccacgtgatcctctaatggacgagcccctgcaggcagaggaaacagccgtgcaaaggccccgaggcagcagcgagctcttgcaggaaggccgcgtgaggctgcagccaaatgggcaaggtcagagtgaggagcagaggccagaaccacagggagggagcggccagaccctccacggccttagggcgtccctgagattccgtcaggaaagggatgtaatcggatcaccctgggaacagtggggaaaattgactccagggagtcaggaggattcaaggacaccccccaccactgtctctctccagcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaatgatacatgaatcttggccacaatgagaaaaataaaaatgaaaaaagagcaggcatccatttccatacaggaacaaaataggaggcagcactacagaccctacacacagctttacagaggtgaaagaaaactgtcagcaattctatgctgacataacagaaaatgtagatgagatagatgaaatacgaaaaattacagtttacttaatgaacataaggataaatagaaaaactgaatcatcatacataaacatatataaaatgcattgatcctgtaatcaaaaatgttcccacaaagtaaatgccacttcagcaaggaaa

SEQ ID NO: 305143 - DNA, 3259 bp, Homo sapiens
cccattttggacttgtgacctccgggacgagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcgggtgagaacccgcccctgtccccggcaccaaaggcctcctggtgccagatctaatcctgcaggacttctctgtcctccttcccccggctctcagcatcgtcacggtggacccctccttgtccagcacgctgcctcctgcctgctgggacctcactctctcctgctgtcctgggacctcatgggcctcctcccgggtccccttcctgctcctcatcctctgtttggccatctggttgttagagagctccccaggcctcaggaggatgacgaataaatgaaccactccagtcccctgggctccccttcattcattcatctagtgagtgttcccagggagctcactgtggatggggctccccatgggagctgcagacacagcagggagcaaagccgcccccgcctcctgagctcacctcgtggtgggagacaaaatgcaaataaatgcatcgtgtccaggagtgcaacgtgctgtaaggaacataaaccaggtaaagggcagagagtgtggggcagtggggccagtctgaatggaaagggagggctgtctgctcagctgtcatctgagaagcctggacggagagggccacgtgatcctctaatggacgagcccctgcaggcagaggaaacagccgtgcaaaggccccgaggcagcagcgagctcttgcaggaaggccgcgtgaggctgcagccaaatgggcaaggtcagagtgaggagcagaggccagaaccacagggagggagcggccagaccctccacggccttagggcgtccctgagattccgtcaggaaagggatgtaatcggatcaccctgggaacagtggggaaaattgactccagggagtcaggaggattcaaggacaccccccaccactgtctctctccagcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggtgagtcctttcctctccaggcccccaggcctcccccacccccaccacgttccttccctctcactctcccccgctgcaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaatgatacatgaatcttggccacaatgagaaaaataaaaatgaaaaaagagcaggcatccatttccatacaggaacaaaataggaggcagcactacagaccctacacacagctttacagaggtgaaagaaaactgtcagcaattctatgctgacataacagaaaatgtagatgagatagatgaaatacgaaaaattacagtttacttaatgaacataaggataaatagaaaaactgaatcatcatacataaacatatataaaatgcattgatcctgtaatcaaaaatgttcccacaaagtaaatgccacttcagcaaggaaa

SEQ ID NO: 305144 - DNA, 488 bp, Homo sapiens
tcctcactgttgaactgagaattgaggatagtgagagagagaacctagtggatatctgggaggagagctttgcagacagagggagcagcatgttcttgagaagctcaagatgagtatgcttggctagaagcatcagggaggtccgtgtgactggagcaaagaaagtaggagctgagaagtcagagagctggctggggtacatatcacataaggcctcctagaccttttgcttttctctgagtgaaatgtgaaaccattgaagagtttgaagtagcgaatgatctggttttatatttcataccatgttgaggaaaagggcaaggttgaggtaggcagatgagttagaaggcttcggcgttaatccacgtgaccggaggtagtaagaagaggtccgatttttgatctgttttgaaagtagaattgtcaagttttgctgatcatttgaatgtagagtgtgtgagagagaaaaagtttaaaaataactccca

SEQ ID NO: 305145 - DNA, 2420 bp, Homo sapiens
agcggggacgctgcgaggtcccgccccgcctgctggccgcggtaaaagtggtagcagcggaggcgagcggagggtttcccgcggcggagtctcactctgctgcctaggctgagtgcagtggtgtgatcgaggcgcactgcagccttgacctcctgggctcaagcgatcctcacctcggcctaccgagtagctgggactacaggcacgcgccactacactcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcagtggcgggaccactggatgcagtgtgtgtacttcctgccacaagaggagcctgtggtgcagggctcagcgctctatctggtagcccaccacgatgactactgcgtatggtacagcctgcagaggaccagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtgctgaagccagacagcgtgtgcctgtgtgtcagcgatggcagcctgctctccgtgctggcccatcacctgggggtggagcaggtgtttacagtcgagagttcagcagcttctcacaaactgttgagaaaaatcttcaaggctaaccacttggaagataaaattaacatcatagagaaacggccggaattattaacaaatgaggacctacagggcagaaaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctggga

SEQ ID NO: 305146 - DNA, 797 bp, Homo sapiens
gccaagccggggagcggtacctctgtctagctgccggcctgtctctgcagcccccaggcccccttctgttcgcagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctgggattctgagtggctcatggctttctagcggggaaggctgaaggccctcctctcctctctgggagctgctcggcctcagggatgggaaagactgcgccgtgttgcatcttgttgcatctttgcactgctggcctctggctccagctgtggcaggaagcatgagagggtgactgaatttggagccctggaggggctgggaagacccccctgcttgtgcttctgaggtgctgagaatgctccaacacagagacatctctccc

SEQ ID NO: 305147 - DNA, 371 bp, Homo sapiens
agcggggacgctgcgaggtcccgccccgcctgctggccgcggtaaaagtggtagcagcggaggcgagcggagggtttcccgcggcggatttctgacagtcagacttgtccacaagaactcaactggcaaggctgcttttctgtgctaaaactggggagctagtggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctggga

SEQ ID NO: 305148 - DNA, 2285 bp, Homo sapiens
agcggggacgctgcgaggtcccgccccgcctgctggccgcggtaaaagtggtagcagcggaggcgagcggagggtttcccgcggcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcagtggcgggaccactggatgcagtgtgtgtacttcctgccacaagaggagcctgtggtgcagggctcagcgctctatctggtagcccaccacgatgactactgcgtatggtacagcctgcagaggaccagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtgctgaagccagacagcgtgtgcctgtgtgtcagcgatggcagcctgctctccgtgctggcccatcacctgggggtggagcaggtgtttacagtcgagagttcagcagcttctcacaaactgttgagaaaaatcttcaaggctaaccacttggaagataaaattaacatcatagagaaacggccggaattattaacaaatgaggacctacagggcagaaaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctggga

SEQ ID NO: 305149 - DNA, 2248 bp, Homo sapiens
agcggggacgctgcgaggtcccgccccgcctgctggccgcggtaaaagtggtagcagcggaggcgagcggagggtttcccgcggcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaagaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcagtggcgggaccactggatgcagtgtgtgtacttcctgccacaagaggagcctgtggtgcagggctcagcgctctatctggtagcccaccacgatgactactgcgtatggtacagcctgcagaggaccagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtgctgaagccagacagcgtgtgcctgtgtgtcagcgatggcagcctgctctccgtgctggcccatcacctgggggtggagcaggtgtttacagtcgagagttcagcagcttctcacaaactgttgagaaaaatcttcaaggctaaccacttggaagataaaattaacatcatagagaaacggccggaattattaacaaatgaggacctacagggcagaaaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctggga

SEQ ID NO: 305150 - DNA, 2677 bp, Homo sapiens
agcggggacgctgcgaggtcccgccccgcctgctggccgcggtaaaagtggtagcagcggaggcgagcggagggtttcccgcggcggagtctcactctgctgcctaggctgagtgcagtggtgtgatcgaggcgcactgcagccttgacctcctgggctcaagcgatcctcacctcggcctaccgagtagctgggactacaggcacgcgccactacactcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcagtggcgggaccactggatgcagtgtgtgtacttcctgccacaagaggagcctgtggtgcagggctcagcgctctatctggtagcccaccacgatgactactgcgtatggtacagcctgcagaggaccagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtgctgaagccagacagcgtgtgcctgtgtgtcagcgatggcagcctgctctccgtgctggcccatcacctgggggtggagcaggtgtttacagtcgagagttcagcagcttctcacaaactgttgagaaaaatcttcaaggctaaccacttggaagataaaattaacatcatagagaaacggccggaattattaacaaatgaggacctacagggcagaaaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctgggattctgagtggctcatggctttctagcggggaaggctgaaggccctcctctcctctctgggagctgctcggcctcagggatgggaaagactgcgccgtgttgcatcttgttgcatctttgcactgctggcctctggctccagctgtggcaggaagcatgagagggtgactgaatttggagccctggaggggctgggaagacccccctgcttgtgcttctgaggtgctgagaatgctccaacacagagacatctctccc

SEQ ID NO: 305151 - DNA, 2198 bp, Homo sapiens
agcggggacgctgcgaggtcccgccccgcctgctggccgcggtaaaagtggtagcagcggaggcgagcggagggtttcccgcggcggagtctcactctgctgcctaggctgagtgcagtggtgtgatcgaggcgcactgcagccttgacctcctgggctcaagcgatcctcacctcggcctaccgagtagctgggactacaggcacgcgccactacactcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcagtggcgggaccactggatgcagtgtgtgtacttcctgccacaagaggagcctgtggtgcagggctcagcgctctatctggtagcccaccacgatgactactgcgtatggtacagcctgcagaggaccagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctggga

SEQ ID NO: 305152 - DNA, 1003 bp, Homo sapiens
agcggggacgctgcgaggtcccgccccgcctgctggccgcggtaaaagtggtagcagcggaggcgagcggagggtttcccgcggcggagtctcactctgctgcctaggctgagtgcagtggtgtgatcgaggcgcactgcagccttgacctcctgggctcaagcgatcctcacctcggcctaccgagtagctgggactacaggcacgcgccactacactcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggtaagcttggaggctgaagcagctccactgtgaatgctaatcctccacgctgacttctgaccaaccccagcttcaggaatgcctctaaaatttccgctctcatgcactttgatgtaaatcctgccctcaggtcagaacaactttgatgttatcataaatacatacttaccgtaaatcctgcccttcgtcaaattccctgtggtatgtaagccctgcgtctgagccataacagtgtgggggcccagtttctcactgcccgagacaaggcttctgtttgtatgtctctataaagtgtgtctttctgagaagctggatttgccagtctttcctcagcctctcagctcccgtggcctgttggggtaggtttgcatagagctgcccaccatggaacagtatgtatgtatagcaaaaaaaaa

SEQ ID NO: 305153 - DNA, 620 bp, Homo sapiens
agcggggacgctgcgaggtcccgccccgcctgctggccgcggtaaaagtggtagcagcggaggcgagcggagggtttcccgcggcggagtctcactctgctgcctaggctgagtgcagtggtgtgatcgaggcgcactgcagccttgacctcctgggctcaagcgatcctcacctcggcctaccgagtagctgggactacaggcacgcgccactacactcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggtaagccattcccttcaggtgtgtgtcctgcat

SEQ ID NO: 305154 - DNA, 612 bp, Homo sapiens
agcggggacgctgcgaggtcccgccccgcctgctggccgcggtaaaagtggtagcagcggaggcgagcggagggtttcccgcggcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtactgggttggtttacagcaggctgcagctgggtggggcacttgatctcaaagcagatgccttgggctccagtctgagcgtgggctaggctgtcacccagtgcttatgatgagggctggtgttggtcctgagcaggtctgctcagccaggtaggtatatgtagcagttaggcaaaatcatgcctgtttggagagtcagacattatgtagcagccttagcagagcctcagcatctgtttaacggagcaaagaaaacccaagcctcagtagtgttgatgaagttgaatcatttacttgccttactgaaatggtgacatgttcatcatatggttaaattcttttgaatg

SEQ ID NO: 305155 - DNA, 687 bp, Homo sapiens
agcggggacgctgcgaggtcccgccccgcctgctggccgcggtaaaagtggtagcagcggaggcgagcggagggtttcccgcggcggagtctcactctgctgcctaggctgagtgcagtggtgtgatcgaggcgcactgcagccttgacctcctgggctcaagcgatcctcacctcggcctaccgagtagctgggactacaggcacgcgccactacactcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagagtaagtgtaaaaggaaactattatcttgatgtggggtgttttgaagtcttggattacaagaaggttaagaatccctgggggtcatgatgttaaatgatactgagaggcgtaaggtgtagaagtcaggaaatcagttgggagactgggtcctacttctggctctatttttgttgtttaatctcccagctttatcaagatagaactgacaaataaaaatggtctatgtttatggtaatacaatgtgatgaat

SEQ ID NO: 305156 - DNA, 405 bp, Homo sapiens
gatccccggcatccccgctgtgcctggcacggaatgagagtccctaatcacaagttaaagccagctgaatctcagccctttttcatgatgcacatttggagaataaagtatttaagttacatatcttaggaccagaatcaaggaatagcttgctcaccttaaaggtcagactactgtttaatttattgctcatttttccttgggtttcggctctattttctaggttttcaagcctatggctgatgctgctgtgaagattgtggagaaaaatggctttagtgataagattaaggttatcaacaagcattccaccgaggtgactgtaggtccaggtgagatttacacaccctgtgttgaaagctttgcttgctcttgtgtgagagaggaaaagggttattccagtta

SEQ ID NO: 305157 - DNA, 593 bp, Homo sapiens
gtaaaaccccgtctctactaaaaatacaaaaattagccaggcgtggtggcacatgcctgtagtcccagctacttgggaggctgaggcagaagaatagcttgaacctggggggcggaggttgcggtgagccgagatcaagccactgcaatccagcctggacgacagagcgagactccgtttcaaaataaataaataaataaataaataaataaataaataaataaataagtagagacagggtttctccatgttgctcaggctggtctcgaactcccaacctcaggttatctgccttggccttccaaagtgctgggattataggcgtgagccatggtgctgggcagagaattgttaaatctacctatgacctggaaggcccatcccccacctccctcctttgagttgttccacccttccatatcaaaccaatgtaaatcttacatgtattgattgatgccttatgtctctctaaaatttataaaagcaagctgtaccccaaccactttggtcgcatgttgtcagggcctcctgaggctgtgtcacaggtgcgtctttagccttggcaaaataaactttctaaattgattgagacc

SEQ ID NO: 305158 - DNA, 799 bp, Homo sapiens
ttaaattttaaaaatccaatgatatgctatttactatactcacactttgaaaacatggagatataagaaaatcaaaagtcaaaatatgatactctgcccctccaccaaataaaacagcattaaaaaagacttaaaaagcagcactagagagaacatgggtcactacataatgataaaactattttaaatatacatgcacctgagaatatggcttcaaaatatgtgaagcaaaaattgacataactgaaaaaaagttgtcaaatccacctccaaaatgggaggatttaactaacccctttctcagccactgaaaagagtcagacattaacagatttgatctaattgatatacataacattgcaaaataacaaacactataattgaagaatacatacttttcaagcagacaaaaaacactatgaaagttgtgcacaaattgttccgtaaataaactcttcataaatttcaagtttgaggaaatacagataacaatttctgaccaattaagttagaattcaataaataaagataattaggaaaccccaaaagttcagaaatatgaaaatgcacacaggaagaacttaagggaaaaaaaggaataaataatagtagttaccaaaaatataataaaaactaaataacacaaaatattaaaacattgtgtcatctggtttaagtggtacttaaatagaaagccttgacaaaacagaaagccttaatgtatgtattagaaaacaagcaaacttcaacgttattgagctaatcacgtaagagaggaagaggaagaggaaaaatagaa

SEQ ID NO: 305159 - DNA, 4504 bp, Homo sapiens
  misc_feature (3)..(3): n is a, c, g, or t
  misc_feature (6)..(6): n is a, c, g, or t
cgnccngccccgccgccggtgcagtgttggaagctccggttctcccggaagtggcccaggtctctctgtcggggtcccctccatctcgctgctgctgaaggccgcgagggcggcggcgatggcggaggcggcgctgttgctgctgcctgaggcggcggcggagcgggacgctagggaaaagctggctctctgggatcggagaccggacacgacggcgccgctgaccgacaggcagacggactcggtattggagctgaaggcggcggcagagaacttgccggtgccagctgagcttccaattgaagacttgtgcagtttaacatcccagtcactgcccattgaactgacttcagtagtgcctgaatctacagaagacattctcttgaagggcttcacttccttaggaatggaagaagaaagaattgaaaccgcacagcagtttttctcatggtttgcaaagctgcaaactcagatggatcaagatgaaggaactaaatatagacagatgagggattacttgtctgggtttcaggagcagtgtgatgctatattgaatgatgtaaacagtgctcttcagcatctggagtctttgcagaaacagtatctttttgtgtccaataagacaggaaccctacatgaagcctgtgaacagctcctaaaagaacagtcggaacttgttgatctggctgaaaacattcaacaaaagctttcctattttaacgaattggaaactattaacacaaaattgaattcccctacattgtcggtgaatagtgacggatttatacctatgctggccaagttagatgattgtataacatatatctcatctcatcctaattttaaagattatcccatatatttgctgaagtttaaacagtgtctttctaaagctttgcacctcatgaagacatatactgtgaacacactacagaccctcacaagtcagttactgaaaagggatccttcatctgtacctaatgcagacaatgccttcacattattttatgtgaaatttcgagctgctgcccccaaagtcagaactcttattgaacaaatagaactgcggtctgaaaaaatacctgaataccaacaactgctaaatgatatccaccagtgttaccttgatcagcgggagctccttttgggccctagtattgcttgcactgttgcagagttaaccagccaaaataatagagatcactgtgccttggttcgtagtggctgtgccttcatggttcatgtctgccaggatgaacaccaactttacaatgaatttttcacaaaaccaacatcaaaattagatgagcttttggagaaactgtgtgtgtcattgtatgatgtcttcaggccattgatcattcatgttattcacttagagactctgtcggaactttgtgggattcttaaaaatgaagtgcttgaagatcatgtgcagaacaatgctgagcaactgggggcatttgcagctggagtcaagcagatgttagaagatgtacaggagcggctcgtctaccgaacccacatctatattcagacggacatcacgggctataaaccagctcctggagatctggcatatcccgataagttagtcatgatggagcaaattgcacagagtttgaaagatgaacagaagaaggtaccttcagaagcttcattttcagatgttcacttagaagaaggagagtctaacagtctgacaaaatctggttcaacagaatccctcaatcctagaccacagaccacaatttctccagcagatcttcatggaatgtggtatcctacggttcgaagaactcttgtctgtctctccaaattatacagatgcatagatagggcagtgttccaaggattatcacaggaagcattgtctgcctgcattcagtccttacttggagcgtcagagtctatcagcaaaaacaagactcagattgatggacaacttttcttaattaagcaccttttgatacttcgtgaacaaattgctccatttcacactgaattcaccattaaggaaatttccctggacctcaagaaaactagagatgcagcatttaaaatcctgaaccctatgactgtcccaagattttttaggctgaatagcaacaatgccttgatagagttcttgttggagggtactcctgagataagagaacattatcttgactctaaaaaagacgtagaccgtcatctgaaatcggcctgtgagcagtttattcagcagcagaccaagctgtttgtagaacagctggaggagttcatgacaaaggtttcagcgttaaaaacaatggccagtcagggaggccccaagtatactctctcacagcagccttgggcacaaccagcaaaggtcaatgaccttgcggcaactgcatataagacaataaaaacaaagctgcctgtgacattgagaagtatgtccttgtacctatccaataaagataccgagttcatcttgtttaaacctgtgaggaataatattcagcaagtcttccagaagttccacgctctgttaaaggaagagttcagccctgaagacatccagatcattgcctgtccatctatggaacagctgagccttctgctgtcagtttctaaataagcaggccagccgggctgtgcacctaaatgtctgtctgggaggagcaggctgagaagtcttgcagtctgcaggacaccgaggaatcgtatgtgggaacgtccccgagaaccacacgagcgtgctgctcagtgctgactgcagaatgaaatagaagcaaagtgttacaggatcagtgttttcttttctaaaacatcaaaatgccaaagattaatctgtgattggtgataactgcctcgtttaaatggtcacaagaaatgtgaagagagagctagggcagacatgcagtgaaatggttctttgttaaaaatgtgcaataaaaatagattacaataagtagtgcaaagaactttacagaaatcaagcgaattagaaggcctgtaagagtaaggtttgctaaaacgtgaaacactgtaacacttttaaccactgagcattccacagtgaaatgttatttctatgctcttatttaatgtaatgtttctcctgtcatttttgaagttgagtttggagtagattggttgcttctgagaacacattctgccttcctgggaagtcggggtgtcatcctttcctctgtttgatgtgaggtagtttaaagatacaaggactttgtgtgaagctccagcatctgtgccccttgaattgcttaggtgcagacagttctaaagcaaggagctgcagcattctcatcatagatacgtgcagtatctttaatgagtatcttcatggtatgatagtgtgtgtttgtgagtgcgaagtaccaattaaggtgtcttaaatttggcgcatagaggagagaaggaaacctgaggagtagtgttcctcctgaatgaaggttcaggtcaccagccttctgtacactgcctttggttttagcagttctttgaaaagcaaacactttcatgtcctgtctattcattcagctggctgtgctgtgctgtggaccagctgtgtggatctctagcccagctacagcagaatacattttaccagcaaacctaaggatgacaaacactatccacatctgaaaactaccacaccatatcagggatcataaattatgcatatctatgaattttccaacaaattcctacttcctgattggattggttttgccgctgatgttaaggcagccagcttcttagttcaaaaagaattctgagtttttcaaacactagtctagaggtggacattgtcaggggttctggaatgggaccaggggaccttttggtgcagtgggtgcctgtaactcattagacgtactgaggcagcacttctgcagggtgcataccctgattgttgtcatttgtaacaggtcacttccttttcactcagtttaaattggtgatggacgttgcttgattgagcttattactctctattttgagaaggtagaaggtaagagggcccatattcattctttgccatgaaatgaatgaattaggaagattgtatttacttaactgttttttaaatacatgtttaatgaaataaactgtaaaatatccagttttgtgtattatatgtacatttgatttttaatagcctttccaaagaaatgagggcatgattattgtacagtaagtacgtgactgatttaatttgatttacagagcggagtgtgttcttataaaaatatttaatgacattggttcttgtcttttgatcttttatttctgaaacactcaaacaccttacaaagtgctgagtaggtaatagtgacccaacttgtttgctaaatgattatttgtttaaatctgtacagttttaagtgttcacttatacaaagagtgtatatactttcaaataatttaaaatgctttatattatttggctagaaattgctgtttttaataaatgtgaattttttaaaaataaagatttttgcttcctaccttg

SEQ ID NO: 305160 - DNA, 4252 bp, Homo sapiens
  misc_feature (3)..(3): n is a, c, g, or t
  misc_feature (6)..(6): n is a, c, g, or t
cgnccngccccgccgccggtgcagtgttggaagctccggttctcccggaagtggcccaggtctctctgtcggggtcccctccatctcgctgctgctgaaggccgcgagggcggcggcgatggcggaggcggcgctgttgctgctgcctgaggcggcggcggagcgggacgctagggaaaagctggctctctgggatcggagaccggacacgacggcgccgctgaccgacaggcagacggactcggtattggagctgaaggcggcggcagagaacttgccggtgccagctgagcttccaattgaagacttgtgcagtttaacatcccagtcactgcccattgaactgacttcagtagtgcctgaatctacagaagacattctcttgaagggcttcacttccttaggaatggaagaagaaagaattgaaaccgcacagcagtttttctcatggtttgcaaagctgcaaactcagatggatcaagatgaaggaactaaatatagacagatgagggattacttgtctgggtttcaggagcagtgtgatgctatattgaatgatgtaaacagtgctcttcagcatctggagtctttgcagaaacagtatctttttgtgtccaataagacaggaaccctacatgaagcctgtgaacagctcctaaaagaacagtcggaacttgttgatctggctgaaaacattcaacaaaagctttcctattttaacgaattggaaactattaacacaaaattgaattcccctacattgtcggtgaatagtgacggatttatacctatgctggccaagttagatgattgtataacatatatctcatctcatcctaattttaaagattatcccatatatttgctgaagtttaaacagtgtctttctaaagctttgcacctcatgaagacatatactgtgaacacactacagaccctcacaagtcagttactgaaaagggatccttcatctgtacctaatgcagacaatgccttcacattattttatgtgaaatttcgagctgctgcccccaaagtcagaactcttattgaacaaatagaactgcggtctgaaaaaatacctgaataccaacaactgctaaatgatatccaccagtgttaccttgatcagcgggagctccttttgggccctagtattgcttgcactgttgcagagttaaccagccaaaataatagagatcactgtgccttggttcgtagtggctgtgccttcatggttcatgtctgccaggatgaacaccaactttacaatgaatttttcacaaaaccaacatcaaaattagatgagcttttggagaaactgtgtgtgtcattgtatgatgtcttcaggccattgatcattcatgttattcacttagagactctgtcggaactttgtgggattcttaaaaatgaagtgcttgaagatcatgtgcagaacaatgctgagcaactgggggcatttgcagctggagtcaagcagatgttagaagatgtacaggagcggctcgtctaccgaacccacatctatattcagacggacatcacgggctataaaccagctcctggagatctggcatatcccgataagttagtcatgatggagcaaattgcacagagtttgaaagatgaacagaagaaggtaccttcagaagcttcattttcagatgttcacttagaagaaggagagtctaacagtctgacaaaatctggttcaacagaatccctcaatcctagaccacagaccacaatttctccagcagatcttcatggaatgtggtatcctacggttcgaagaactcttgtctgtctctccaaattatacagatgcatagatagggcagtgttccaaggattatcacaggaagcattgtctgcctgcattcagtccttacttggagcgtcagagtctatcagcaaaaacaagactcagattgatggacaacttttcttaattaagcaccttttgatacttcgtgaacaaattgctccatttcacactgaattcaccattaaggaaatttccctggacctcaagaaaactagagatgcagcatttaaaatcctgaaccctatgactgtcccaagattttttaggctgaatagcaacaatgccttgatagagttcttgttggagggtactcctgagataagagaacattatcttgactctaaaaaagacgtagaccgtcatctgaaatcggcctgtgagcagtttattcagcagcagaccaagctgtttgtagaacagctggaggagttcatgacaaaggtttcagcgttaaaaacaatggccagtcagggaggccccaagtatactctctcacagcagccttgggcacaaccagcaaaggtcaatgaccttgcggcaactgcatataagacaataaaaacaaagctgcctgtgacattgagaagtatgtccttgtacctatccaataaagataccgagttcatcttgtttaaacctgtgaggaataatattcagcaagtcttccagaagttccacgctctgttaaaggaagagttcagccctgaagacatccagatcattgcctgtccatctatggaacagctgagccttctgctgtcagtttctaaataagcaggccagccgggctgtgcacctaaatgtctgtctgggaggagcaggctgagaagtcttgcagtctgcaggacaccgaggaatcgtatgtgggaacgtccccgagaaccacacgagcgtgctgctcagtgctgactgcagaatgaaatagaagcaaagtgttacaggatcagtgttttcttttctaaaacatcaaaatgccaaagattaatctgtgattggtgataactgcctcgtttaaatggtcacaagaaatgtgaagagagagctagggcagacatgcagtgaaatggttctttgttaaaaatgtgcaataaaaatagattacaataagtagtgcaaagaactttacagaaatcaagcgaattagaaggcctgtaagagtaaggtttgctaaaacgtgaaacactgtaacacttttaaccactgagcattccacagtgaaatgttatttctatgctcttatttaatgtaatgtttctcctgtcatttttgaagttgagtttggagtagattggttgcttctgagaacacattctgccttcctgggaagtcggggtgtcatcctttcctctgtttgatgtgaggtagtttaaagatacaaggactttgtgtgaagctccagcatctgtgccccttgaattgcttaggtgcagacagttctaaagcaaggagctgcagcattctcatcatagatacgtgcagtatctttaatgagtatcttcatggtatgatagtgtgtgtttgtgagtgcgaagtaccaattaaggtgtcttaaatttggcgcatagaggagagaaggaaacctgaggagtagtgttcctcctgaatgaaggttcaggtcaccagccttctgtacactgcctttggttttagcagttctttgaaaagcaaacactttcatgtcctgtctattcattcagctggctgtgctgtgctgtggaccagctgtgtggatctctagcccagctacagcagaatacattttaccagcaaacctaaggatgacaaacactatccacatctgaaaactaccacaccatatcagggatcataaattatgcatatctatgaattttccaacaaattcctacttcctgattggattggttttgccgctgatgttaaggcagccagcttcttagttcaaaaagaattctgagtttttcaaacactagtctagaggtggacattgtcaggggttctggaatgggaccaggggaccttttggtgcagtgggtgcctgtaactcattagacgtactgaggcagcacttctgcagggtgcataccctgattgttgtcatttgtaacaggtcacttccttttcactcagtttaaattggtgatggacgttgcttgattgagcttattactctctattttgagaaggtagaaggtaagagggcccatattcattctttgccatgaaatgaatgaattaggaagattgtatttacttaactgttttttaaatacatgtttaatgaaataaactgtaaaatatccagttttgtgtattatatgtacatttgatttttaatagcctttccaaagaaatgagggcatgattattgtacagtaagtacgtgactgatttaatttgatttacagagcggagtgtgttcttataaaaatatttaatgac

SEQ ID NO: 305161 - DNA, 2787 bp, Homo sapiens
  misc_feature (3)..(3): n is a, c, g, or t
  misc_feature (6)..(6): n is a, c, g, or t
cgnccngccccgccgccggtgcagtgttggaagctccggttctcccggaagtggcccaggtctctctgtcggggtcccctccatctcgctgctgctgaaggccgcgagggcggcggcgatggcggaggcggcgctgttgctgctgcctgaggcggcggcggagcgggacgctagggaaaagctggctctctgggatcggagaccggacacgacggcgccgctgaccgacaggcagacggactcggtattggagctgaaggcggcggcagagaacttgccggtgccagctgagcttccaattgaagacttgtgcagtttaacatcccagtcactgcccattgaactgacttcagtagtgcctgaatctacagaagacattctcttgaagggcttcacttccttaggaatggaagaagaaagaattgaaaccgcacagcagtttttctcatggtttgcaaagctgcaaactcagatggatcaagatgaaggaactaaatatagacagatgagggattacttgtctgggtttcaggagcagtgtgatgctatattgaatgatgtaaacagtgctcttcagcatctggagtctttgcagaaacagtatctttttgtgtccaataagacaggaaccctacatgaagcctgtgaacagctcctaaaagaacagtcggaacttgttgatctggctgaaaacattcaacaaaagctttcctattttaacgaattggaaactattaacacaaaattgaattcccctacattgtcggtgaatagtgacggatttatacctatgctggccaagttagatgattgtataacatatatctcatctcatcctaattttaaagattatcccatatatttgctgaagtttaaacagtgtctttctaaagctttgcacctcatgaagacatatactgtgaacacactacagaccctcacaagtcagttactgaaaagggatccttcatctgtacctaatgcagacaatgccttcacattattttatgtgaaatttcgagctgctgcccccaaagtcagaactcttattgaacaaatagaactgcggtctgaaaaaatacctgaataccaacaactgctaaatgatatccaccagtgttaccttgatcagcgggagctccttttgggccctagtattgcttgcactgttgcagagttaaccagccaaaataatagagatcactgtgccttggttcgtagtggctgtgccttcatggttcatgtctgccaggatgaacaccaactttacaatgaatttttcacaaaaccaacatcaaaattagatgagcttttggagaaactgtgtgtgtcattgtatgatgtcttcaggccattgatcattcatgttattcacttagagactctgtcggaactttgtgggattcttaaaaatgaagtgcttgaagatcatgtgcagaacaatgctgagcaactgggggcatttgcagctggagtcaagcagatgttagaagatgtacaggagcggctcgtctaccgaacccacatctatattcagacggacatcacgggctataaaccagctcctggagatctggcatatcccgataagttagtcatgatggagcaaattgcacagagtttgaaagatgaacagaagaaggtaccttcagaagcttcattttcagatgttcacttagaagaaggagagtctaacagtctgacaaaatctggttcaacagaatccctcaatcctagaccacagaccacaatttctccagcagatcttcatggaatgtggtatcctacggttcgaagaactcttgtctgtctctccaaattatacagatgcatagatagggcagtgttccaaggattatcacaggaagcattgtctgcctgcattcagtccttacttggagcgtcagagtctatcagcaaaaacaagactcagattgatggacaacttttcttaattaagcaccttttgatacttcgtgaacaaattgctccatttcacactgaattcaccattaaggcagccagcttcttagttcaaaaagaattctgagtttttcaaacactagtctagaggtggacattgtcaggggttctggaatgggaccaggggaccttttggtgcagtgggtgcctgtaactcattagacgtactgaggcagcacttctgcagggtgcataccctgattgttgtcatttgtaacaggtcacttccttttcactcagtttaaattggtgatggacgttgcttgattgagcttattactctctattttgagaaggtagaaggtaagagggcccatattcattctttgccatgaaatgaatgaattaggaagattgtatttacttaactgttttttaaatacatgtttaatgaaataaactgtaaaatatccagttttgtgtattatatgtacatttgatttttaatagcctttccaaagaaatgagggcatgattattgtacagtaagtacgtgactgatttaatttgatttacagagcggagtgtgttcttataaaaatatttaatgacattggttcttgtcttttgatcttttatttctgaaacactcaaacaccttacaaagtgctgagtaggtaatagtgacccaacttgtttgctaaatgattatttgtttaaatctgtacagttttaagtgttcacttatacaaagagtgtatatactttcaaataatttaaaatgctttatattatttggctagaaattgctgtttttaataaatgtgaattttttaaaaataaagatttttgcttcctaccttg

SEQ ID NO: 305162 - DNA, 486 bp, Homo sapiens
ttgagctcggtaccagttcgacggagactctccttcttcagaagcttcattttcagatgttcacttagaagaaggagagtctaacagtctgacaaaatctggttcaacagaatccctcaatcctagaccacagaccacaatttctccagcagatcttcatggaatgtggtatcctacggttcgaagaactcttgtctgtctctccaaattatacagatgcatagatagggcagtgttccaaggattatcacaggaagcattgtctgcctgcattcagtccttacttggagcgtcagagtctatcagcaaaaacaaggtttgatgaagtgttaggtgaaatcctgtttcctggtaaaatattgtggaatatagcatttacttataggcacagaagtttaaagctgttttggcagtaggatttgtttaacatgattgaattttgaggctctttgagagtctccgtcgaactggtaccgagctcgatga

SEQ ID NO: 305163 - DNA, 400 bp, Homo sapiens
  misc_feature (3)..(3): n is a, c, g, or t
  misc_feature (6)..(6): n is a, c, g, or t
cgnccngccccgccgccggtgcagtgttggaagctccggttctcccggaagtggcccaggtctctctgtcggggtcccctccatctcgctgctgctgaaggccgcgagggcggcggcgatggcggaggcggcgctgttgctgctgcctgaggcggcggcggagcgggacgctagggaaaagctggctctctgggatcggagaccggacacgacggcgccgctgaccgacaggcagacggactcggtattggagctgaaggcggcggcagagaacttgccggtgccagctgaggatatggtaccggaagtggatctgaaatcaatgaaggcgcaggtggaaatttctttggctcagctatcaaactcttttataccctggataataaaagttgtttgctct

SEQ ID NO: 305164 - DNA, 209 bp, Homo sapiens
cacaatcttagtaatttttgccaatcatctgtaaatatctcactgctttcatttacatttatttatgagtgaggttgagcatctttgaaattgttaatagtcttttttctttgtagttttctagataacttcttttaaatacttcctacagattactactctccttttctatgtaactccttcagacatgacacttgggtttcatagtt

SEQ ID NO: 305165 - DNA, 2108 bp, Homo sapiens
ttattttatttttcaacttttattttagattcaaggggtacatacatgcaggtttgttacctggctgtattgcatgatgctgaggtttttcaacccttgtggttcccctccctccttgacttttcttgaggacggtattccataggagaactaacatagctcttaattttgcttttcagctgagccttctgctgtcagtttctaaataagcaggccagccgggctgtgcacctaaatgtctgtctgggaggagcaggctgagaagtcttgcagtctgcaggacaccgaggaatcgtatgtgggaacgtccccgagaaccacacgagcgtgctgctcagtgctgactgcagaatgaaatagaagcaaagtgttacaggatcagtgttttcttttctaaaacatcaaaatgccaaagattaatctgtgattggtgataactgcctcgtttaaatggtcacaagaaatgtgaagagagagctagggcagacatgcagtgaaatggttctttgttaaaaatgtgcaataaaaatagattacaataagtagtgcaaagaactttacagaaatcaagcgaattagaaggcctgtaagagtaaggtttgctaaaacgtgaaacactgtaacacttttaaccactgagcattccacagtgaaatgttatttctatgctcttatttaatgtaatgtttctcctgtcatttttgaagttgagtttggagtagattggttgcttctgagaacacattctgccttcctgggaagtcggggtgtcatcctttcctctgtttgatgtgaggtagtttaaagatacaaggactttgtgtgaagctccagcatctgtgccccttgaattgcttaggtgcagacagttctaaagcaaggagctgcagcattctcatcatagatacgtgcagtatctttaatgagtatcttcatggtatgatagtgtgtgtttgtgagtgcgaagtaccaattaaggtgtcttaaatttggcgcatagaggagagaaggaaacctgaggagtagtgttcctcctgaatgaaggttcaggtcaccagccttctgtacactgcctttggttttagcagttctttgaaaagcaaacactttcatgtcctgtctattcattcagctggctgtgctgtgctgtggaccagctgtgtggatctctagcccagctacagcagaatacattttaccagcaaacctaaggatgacaaacactatccacatctgaaaactaccacaccatatcagggatcataaattatgcatatctatgaattttccaacaaattcctacttcctgattggattggttttgccgctgatgttaaggcagccagcttcttagttcaaaaagaattctgagtttttcaaacactagtctagaggtggacattgtcaggggttctggaatgggaccaggggaccttttggtgcagtgggtgcctgtaactcattagacgtactgaggcagcacttctgcagggtgcataccctgattgttgtcatttgtaacaggtcacttccttttcactcagtttaaattggtgatggacgttgcttgattgagcttattactctctattttgagaaggtagaaggtaagagggcccatattcattctttgccatgaaatgaatgaattaggaagattgtatttacttaactgttttttaaatacatgtttaatgaaataaactgtaaaatatccagttttgtgtattatatgtacatttgatttttaatagcctttccaaagaaatgagggcatgattattgtacagtaagtacgtgactgatttaatttgatttacagagcggagtgtgttcttataaaaatatttaatgacattggttcttgtcttttgatcttttatttctgaaacactcaaacaccttacaaagtgctgagtaggtaatagtgacccaacttgtttgctaaatgattatttgtttaaatctgtacagttttaagtgttcacttatacaaagagtgtatatactttcaaataatttaaaatgctttatattatttggctagaaattgctgtttttaataaatgtgaattttttaaaaataaagatttttgcttcctaccttg

SEQ ID NO: 305166 - DNA, 4450 bp, Homo sapiens
  misc_feature (3)..(3): n is a, c, g, or t
  misc_feature (6)..(6): n is a, c, g, or t
cgnccngccccgccgccggtgcagtgttggaagctccggttctcccggaagtggcccaggtctctctgtcggggtcccctccatctcgctgctgctgaaggccgcgagggcggcggcgatggcggaggcggcgctgttgctgctgcctgaggcggcggcggagcgggacgctagggaaaagctggctctctgggatcggagaccggacacgacggcgccgctgaccgacaggcagacggactcggtattggagctgaaggcggcggcagagaacttgccggtgccagctgagcttccaattgaagacttgtgcagtttaacatcccagtcactgcccattgaactgacttcagtagtgcctgaatctacagaagacattctcttgaagggcttcacttccttaggaatggaagaagaaagaattgaaaccgcacagcagtttttctcatggtttgcaaagctgcaaactcagatggatcaagatgaaggaactaaatatagacagatgagggattacttgtctgggtttcaggagcagtgtgatgctatattgaatgatgtaaacagtgctcttcagcatctggagtctttgcagaaacagtatctttttgtgtccaataagacaggaaccctacatgaagcctgtgaacagctcctaaaagaacagtcggaacttgttgatctggctgaaaacattcaacaaaagctttcctattttaacgaattggaaactattaacacaaaattgaattcccctacattgtcggtgaatagtgacggatttatacctatgctggccaagttagatgattgtataacatatatctcatctcatcctaattttaaagattatcccatatatttgctgaagtttaaacagtgtctttctaaagctttgcacctcatgaagacatatactgtgaacacactacagaccctcacaagtcagttactgaaaagggatccttcatctgtacctaatgcagacaatgccttcacattattttatgtgaaatttcgagctgctgcccccaaagtcagaactcttattgaacaaatagaactgcggtctgaaaaaatacctgaataccaacaactgctaaatgatatccaccagtgttaccttgatcagcgggagctccttttgggccctagtattgcttgcactgttgcagagttaaccagccaaaataatagagatcactgtgccttggttcgtagtggctgtgccttcatggttcatgtctgccaggatgaacaccaactttacaatgaatttttcacaaaaccaacatcaaaattagatgagcttttggagaaactgtgtgtgtcattgtatgatgtcttcaggccattgatcattcatgttattcacttagagactctgtcggaactttgtgggattcttaaaaatgaagtgcttgaagatcatgtgcagaacaatgctgagcaactgggggcatttgcagctggagtcaagcagatgttagaagatgtacaggagcggctcgtctaccgaacccacatctatattcagacggacatcacgggctataaaccagctcctggagatctggcatatcccgataagttagtcatgatggagcaaattgcacagagtttgaaagatgaacagaagaaggtaccttcagaagcttcattttcagatgttcacttagaagaaggagagtctaacagtctgacaaaatctggttcaacagaatccctcaatcctagaccacagaccacaatttctccagcagatcttcatggaatgtggtatcctacggttcgaagaactcttgtctgtctctccaaattatacagatgcatagatagggcagtgttccaaggattatcacaggaagcattgtctgcctgcattcagtccttacttggagcgtcagagtctatcagcaaaaacaagactcagattgatggacaacttttcttaattaagcaccttttgatacttcgtgaacaaattgctccatttcacactgaattcaccattaaggaaatttccctggacctcaagaaaactagagatgcagcatttaaaatcctgaaccctatgactgtcccaagattttttaggctgaatagcaacaatgccttgatagagttcttgttggagggtactcctgagataagagaacattatcttgactctaaaaaagacgtagaccgtcatctgaaatcggcctgtgagcagtttattcagcagcagaccaagctgtttgtagaacagctggaggagttcatgacaaaggtttcagcgttaaaaacaatggccagtcagggaggccccaagtatactctctcacagcagccttgggcacaaccagcaaaggtcaatgaccttgcggcaactgcatataagacaataaaaacaaagctgcctgtgacattgagaagtatgtccttgtacctatccaataaagataccgagttcatcttgtttaaacctgtgaggaataatattcagcaagtcttccagaagttccacgctctgttaaaggaagagttcagccctgaagacatccagatcattgcctgtccatctatggaacagctgagccttctgctgtcagtttctaaataagcaggccagccgggctgtgcacctaaatgtctgtctgggaggagcaggctgagaagtcttgcagtctgcaggacaccgaggaatcgtatgtgggaacgtccccgagaaccacacgagcgtgctgctcagtgctgactgcagaatgaaatagaagcaaagtgttacaggatcagtgttttcttttctaaaacatcaaaatgccaaagattaatctgtgattggtgataactgcctcgtttaaatggtcacaagaaatgtgaagagagagctagggcagacatgcagtgaaatggttctttgttaaaaatgtgcaataaaaatagattacaataagtagtgcaaagaactttacagaaatcaagcgaattagaaggcctgtaagagtaaggtttggttatttctatgctcttatttaatgtaatgtttctcctgtcatttttgaagttgagtttggagtagattggttgcttctgagaacacattctgccttcctgggaagtcggggtgtcatcctttcctctgtttgatgtgaggtagtttaaagatacaaggactttgtgtgaagctccagcatctgtgccccttgaattgcttaggtgcagacagttctaaagcaaggagctgcagcattctcatcatagatacgtgcagtatctttaatgagtatcttcatggtatgatagtgtgtgtttgtgagtgcgaagtaccaattaaggtgtcttaaatttggcgcatagaggagagaaggaaacctgaggagtagtgttcctcctgaatgaaggttcaggtcaccagccttctgtacactgcctttggttttagcagttctttgaaaagcaaacactttcatgtcctgtctattcattcagctggctgtgctgtgctgtggaccagctgtgtggatctctagcccagctacagcagaatacattttaccagcaaacctaaggatgacaaacactatccacatctgaaaactaccacaccatatcagggatcataaattatgcatatctatgaattttccaacaaattcctacttcctgattggattggttttgccgctgatgttaaggcagccagcttcttagttcaaaaagaattctgagtttttcaaacactagtctagaggtggacattgtcaggggttctggaatgggaccaggggaccttttggtgcagtgggtgcctgtaactcattagacgtactgaggcagcacttctgcagggtgcataccctgattgttgtcatttgtaacaggtcacttccttttcactcagtttaaattggtgatggacgttgcttgattgagcttattactctctattttgagaaggtagaaggtaagagggcccatattcattctttgccatgaaatgaatgaattaggaagattgtatttacttaactgttttttaaatacatgtttaatgaaataaactgtaaaatatccagttttgtgtattatatgtacatttgatttttaatagcctttccaaagaaatgagggcatgattattgtacagtaagtacgtgactgatttaatttgatttacagagcggagtgtgttcttataaaaatatttaatgacattggttcttgtcttttgatcttttatttctgaaacactcaaacaccttacaaagtgctgagtaggtaatagtgacccaacttgtttgctaaatgattatttgtttaaatctgtacagttttaagtgttcacttatacaaagagtgtatatactttcaaataatttaaaatgctttatattatttggctagaaattgctgtttttaataaatgtgaattttttaaaaataaagatttttgcttcctaccttg

SEQ ID NO: 305167 - DNA, 1397 bp, Homo sapiens
cagtggctgcctcagaaatagaccaacattgtgggccagtttctactttatagccatgtttactggtctcataaaaatcttggtctttttctctcattctgtttttggggctctaaacaactttttttttttccattctaattgttaggtgcagacagttctaaagcaaggagctgcagcattctcatcatagatacgtgcagtatctttaatgagtatcttcatggtatgatagtgtgtgtttgtgagtgcgaagtaccaattaaggtgtcttaaatttggcgcatagaggagagaaggaaacctgaggagtagtgttcctcctgaatgaaggttcaggtcaccagccttctgtacactgcctttggttttagcagttctttgaaaagcaaacactttcatgtcctgtctattcattcagctggctgtgctgtgctgtggaccagctgtgtggatctctagcccagctacagcagaatacattttaccagcaaacctaaggatgacaaacactatccacatctgaaaactaccacaccatatcagggatcataaattatgcatatctatgaattttccaacaaattcctacttcctgattggattggttttgccgctgatgttaaggcagccagcttcttagttcaaaaagaattctgagtttttcaaacactagtctagaggtggacattgtcaggggttctggaatgggaccaggggaccttttggtgcagtgggtgcctgtaactcattagacgtactgaggcagcacttctgcagggtgcataccctgattgttgtcatttgtaacaggtcacttccttttcactcagtttaaattggtgatggacgttgcttgattgagcttattactctctattttgagaaggtagaaggtaagagggcccatattcattctttgccatgaaatgaatgaattaggaagattgtatttacttaactgttttttaaatacatgtttaatgaaataaactgtaaaatatccagttttgtgtattatatgtacatttgatttttaatagcctttccaaagaaatgagggcatgattattgtacagtaagtacgtgactgatttaatttgatttacagagcggagtgtgttcttataaaaatatttaatgacattggttcttgtcttttgatcttttatttctgaaacactcaaacaccttacaaagtgctgagtaggtaatagtgacccaacttgtttgctaaatgattatttgtttaaatctgtacagttttaagtgttcacttatacaaagagtgtatatactttcaaataatttaaaatgctttatattatttggctagaaattgctgtttttaataaatgtgaattttttaaaaataaagatttttgcttcctaccttg

SEQ ID NO: 305168 - DNA, 2097 bp, Homo sapiens
  misc_feature (3)..(3): n is a, c, g, or t
  misc_feature (6)..(6): n is a, c, g, or t
cgnccngccccgccgccggtgcagtgttggaagctccggttctcccggaagtggcccaggtctctctgtcggggtcccctccatctcgctgctgctgaaggccgcgagggcggcggcgatggcggaggcggcgctgttgctgctgcctgaggcggcggcggagcgggacgctagggaaaagctggctctctgggatcggagaccggacacgacggcgccgctgaccgacaggcagacggactcggtattggagctgaaggcggcggcagagaacttgccggtgccagctgagcttccaattgaagacttgtgcagtttaacatcccagtcactgcccattgaactgacttcagtagtgcctgaatctacagaagacattctcttgaagggcttcacttccttaggaatggaagaagaaagaattgaaaccgcacagcagtttttctcatggtttgcaaagctgcaaactcagatggatcaagatgaaggaactaaatatagacagatgagggattacttgtctgggtttcaggagcagtgtgatgctatattgaatgatgtaaacagtgctcttcagcatctggagtctttgcagaaacagtatctttttgtgtccaataagacaggaaccctacatgaagcctgtgaacagctcctaaaagaacagtcggaacttgttgatctggctgaaaacattcaacaaaagctttcctattttaacgaattggaaactattaacacaaaattgaattcccctacattgtcggtgaatagtgacggatttatacctatgctggccaagttagatgattgtataacatatatctcatctcatcctaattttaaagattatcccatatatttgctgaagtttaaacagtgtctttctaaagctttgcacctcatgaagacatatactgtgaacacactacagaccctcacaagtcagttactgaaaagggatccttcatctgtacctaatgcagacaatgccttcacattattttatgtgaaatttcgagctgctgcccccaaagtcagaactcttattgaacaaatagaactgcggtctgaaaaaatacctgaataccaacaactgctaaatgatatccaccagtgttaccttgatcagcgggagctccttttgggccctagtattgcttgcactgttgcagagttaaccagccaaaataatagagatcactgtgccttggttcgtagtggctgtgccttcatggttcatgtctgccaggatgaacaccaactttacaatgaatttttcacaaaaccaacatcaaaattagatgagcttttggagaaactgtgtgtgtcattgtatgatgtcttcaggccattgatcattcatgttattcacttagagactctgtcggaactttgtgggattcttaaaaatgaagtgcttgaagatcatgtgcagaacaatgctgagcaactgggggcatttgcagctggagtcaagcagatgttagaagatgtacaggagcggctcgtctaccgaacccacatctatattcagacggacatcacgggctataaaccagctcctggagatctggcatatcccgataagttagtcatgatggagcaaattgcacagagtttgaaagatgaacagaagaaggtaccttcagaagcttcattttcagatgttcacttagaagaaggagagtctaacagtctgacaaaatctggttcaacagaatccctcaatcctagaccacagaccacaatttctccagcagatcttcatggaatgtggtatcctacggttcgaagaactcttgtctgtctctccaaattatacagatgcatagatagggcagtgttccaaggattatcacaggaagcattgtctgcctgcattcagtccttacttggagcgtcagagtctatcagcaaaaacaaggtttgatgaagtgttaggtgaaatcctgtttcctggtaaaatattgtggaatatagcatttacttataggcacagaagtttaaagctgttttggcagtaggatttgtttaacatgattgaattttgaggctctttgagagtctccgtcgaactggtaccgagctcgatga

SEQ ID NO: 305169 - DNA, 1942 bp, Homo sapiens
  misc_feature (3)..(3): n is a, c, g, or t
  misc_feature (6)..(6): n is a, c, g, or t
cgnccngccccgccgccggtgcagtgttggaagctccggttctcccggaagtggcccaggtctctctgtcggggtcccctccatctcgctgctgctgaaggccgcgagggcggcggcgatggcggaggcggcgctgttgctgctgcctgaggcggcggcggagcgggacgctagggaaaagctggctctctgggatcggagaccggacacgacggcgccgctgaccgacaggcagacggactcggtattggagctgaaggcggcggcagagaacttgccggtgccagctgagcttccaattgaagacttgtgcagtttaacatcccagtcactgcccattgaactgacttcagtagtgcctgaatctacagaagacattctcttgaagggcttcacttccttaggaatggaagaagaaagaattgaaaccgcacagcagtttttctcatggtttgcaaagctgcaaactcagatggatcaagatgaaggaactaaatatagacagatgagggattacttgtctgggtttcaggagcagtgtgatgctatattgaatgatgtaaacagtgctcttcagcatctggagtctttgcagaaacagtatctttttgtgtccaataagacaggaaccctacatgaagcctgtgaacagctcctaaaagaacagtcggaacttgttgatctggctgaaaacattcaacaaaagctttcctattttaacgaattggaaactattaacacaaaattgaattcccctacattgtcggtgaatagtgacggatttatacctatgctggccaagttagatgattgtataacatatatctcatctcatcctaattttaaagattatcccatatatttgctgaagtttaaacagtgtctttctaaagctttgcacctcatgaagacatatactgtgaacacactacagaccctcacaagtcagttactgaaaagggatccttcatctgtacctaatgcagacaatgccttcacattattttatgtgaaatttcgagctgctgcccccaaagtcagaactcttattgaacaaatagaactgcggtctgaaaaaatacctgaataccaacaactgctaaatgatatccaccagtgttaccttgatcagcgggagctccttttgggccctagtattgcttgcactgttgcagagttaaccagccaaaataatagagatcactgtgccttggttcgtagtggctgtgccttcatggttcatgtctgccaggatgaacaccaactttacaatgaatttttcacaaaaccaacatcaaaattagatgagcttttggagaaactgtgtgtgtcattgtatgatgtcttcaggccattgatcattcatgttattcacttagagactctgtcggaactttgtgggattcttaaaaatgaagtgcttgaagatcatgtgcagaacaatggtaaatgagtagaaatgatcattttaagttatatcactggctcaatgaatttgaaaaaaaaataagtgcttcttccctcaccccactaaatagataaatttaatatttttgaagcttggcttgatgccttaccccttcttgaatgaagttgcaccttattctgtcactaaagacacaatcagatagggaaagaatcttaaaatctgggtaaaattagtaataaaataattatagtcagttttctttctggcatctggaatccagatagaacacatcgttacttttgggttaggcatttctagcacactgttaccagaatacaaaatacataaataaataattgaatatattgtatacttttgattaaaaaacaggaattgtttttgtgtatattcataataatagttgatctgttttgaaattacaaataaagaaaagcggttctctggaatagctctactttgtccatctgatacattcttcagtatttgatttga

SEQ ID NO: 305170 - DNA, 420 bp, Homo sapiens
tcccgagtagctgggatcacaggtgcctgccactacacccggctaattttttgtatttttagtagagatggggtttcgccctgttgtccaggctgttctcgaactcctgacctcaagtgatctgcccgcctcggcctccgaaaatgctgggattacagtcgtgagccaccgtgcctggcctgaagcattctttttatacgatttggaattgtgtccaaatgcagattgagtttagagtcttcaactttttctgtcctccaactttagagatttgatttaaacgttctcttcacattcactgttgtatgctcagccatcaaataggcgttctttcttgggtttctttttccacctctaggatatggtaccggaagtggatctgaaatcaatgaaggcgcaggtggaaatttctttggctca

SEQ ID NO: 305171 - DNA, 348 bp, Homo sapiens
agagcagtaccagtttaatttgtcattgatgaaatgaaactttttttctttttgtctcctctattaggtttcagcgttaaaaacaatggccagtcagggaggccccaagtatactctctcacagcagccttgggcacaaccaggtattctgatttgaccattttggatttcttttttaggatgttattagtttgcatttatatagtccttactgtgacagcttggagttggtttcctattcactctggggtgctgcaatctgagttaatgcaggattcaatttggagctgacaggtcttaattggttagcactacttgcatttcagcaagcattccaaggaaggaaga

SEQ ID NO: 305172 - DNA, 768 bp, Homo sapiens
gggtttcatagttatttttgttataactttttgggattctgttccccttctgataatacagtataagaatataacaaatagatatttaattccccttaaatatgtgtggatattttctgaatggtctaagcatctcttactgtgagtcatttctgcaaatgaacaaactcattcattatgaagtaattcttactagtgtctctctgaaaatgacttttttttttttaactttaatctcttacctccaaattccaaaggtacatattacagctcttatgaatgtcctgaagcatgctaggggagttattttgctgccttagcccttgggattagaattttgtatagtagatatttaatgaatgtttatagggcttatgattaaacttggtaaataagctataaaaatgaaagaaattctttggggaaataaagagtcttttcttctgctatttttttctccctttattcccctttgaattaaaatggaaatatttcttttctttttctttatgacactaatgaggttactttatttccagcaaaggtcaatgaccttgcggcaactgcatataagacaataaaaacaaagctgcctgtgacattgagaagtatgtccttgtacctatccaataaagataccgagttcatcttgtttaaacctgtgagggtgagtatcagataactcatttgaatgttggcgggtgacttcaagtattctttgcctcatttaccattttccttttgctgtagacatttagaaatgttggt

SEQ ID NO: 305173 - DNA, 290 bp, Homo sapiens
agggcaagcaggcattgttatttgcacttacagcctaggatattcctttttttttgttttgtcaaatgccacaggctgattattctcttttattccaccagagggcagtgttccaaggattatcacaggaagcattgtctgcctgcattcagtccttacttggagcgtcagagtctatcagcaaaaacaaggtttgatgaagtgttaggtgaaatcctgtttcctggtaaaatattgtggaatatagcatttacttataggcacagaagtttaaagctgttttggcagta

SEQ ID NO: 305174 - DNA, 2225 bp, Homo sapiens
cacttcagaaacccatattcacacacatgtgcacgtgttcacatgaaaagacccccttgcactcaggcccccagagccgaggcattgtgcagccccacagcagccaccttcacagctgctaacagcccctgtgccatgcctgctgcaggcactgtctgctctaggaggggctcttgttttcatggaacccagtggtgaagagacaccccactggcccttctcttccccaattcctgtttcttcattccccatcatttacctgctctttctgtctggtcaagaaagcatgtctcagccaggcccagtggctcagccaggcacagtggctcacaccttctaaccagcactttgggagtctgaagtaggaggattgcttgagcccaggagtttgtgaccagcctgggcaacatagggagatcccatctctacaaataataataataaagagtagctgggagtggtggtacacacccgcggtcccagctacatgggaggctggggtgggaggattgcttgagcctgggaggtcaagggtgcagagagcaatgattgcaccactgcactgtgacctggatgacagagcaaaaccctgtctccagaaaaagaaagaaagaaagaaagcaggtctcaaaagcaatggatgagtattctttaactacaatgtagcagactctttattaaaaatgaaatttgatgtttatttttaatcatgttcaacccactttattctcagatatagtcttcctgtgaataactttcttttcagaatggaggaaccaatctctgtgctgtggatgactccaacgaccatgtgctctctgtatgggactggcagaaagaagaaaaactagcagatgtgaagtgctctaatgaagctgtgtttgctgcggatttccaccccacggacaccaacatcatagttacttgtggaaaatcacatctctacttttggacactagaaggaagctcccttaataagaagcaaggattattcgagaaacaagaaaagccaaagtttgtcctctgtgtgactttctctgaaaacggtgacaccattactggagattcaagtggcaacatcttagtatggggaaaaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggagattccagaacagtttggtccaatacggacagtggccgaggggaaaggcgatgtgatcttgattggcacaactcgaaactttgtcctgcagggcactctgtcaggggacttcacacccattactcagggtcacactgatgagctctggggactggccatccatgcctcaaaacctcagttcttgacctgtgggcatgacaagcatgccactctctgggacgctgtgggtcaccgtcccgtctgggacaaaataatagaggtaaacatgcacattacatttccatttttcttacagaaattcatctggaacatgtttatttattttttgcatgaaatcaacagtgatacaaagttgtcccaaagcaaatgttatttatctatttagagttgccttaacattgcaattgcatttaacagtgttacttttaacattgcctcgtggcctcagccatgtaattttgaagtttactgttgaaattttctgacaagaagttgttctttctgagttcattgtcagattttctgagtacagtctctcaaccatcctaagagctgaaaaatacttgttatgagcctgcattctatttacagtgtaccctttgaatgggaatttacaagctgtactaaacacacgattgaatatatctctacattttgagtttgatggtaaagtgaactttcgtttgaaagtcagctgggcacggtggctcatgcctgtaatcccagcactttgggaggccaaggcaggcagatcacctgaggttgggagctcgagaccagcctgaccaacatggagaaaccccgtctctactaaaaacacaaaattagccgggcatggtggtgcatgcctatactcccagctccttggaaggctgaggcaggagaattgcttgaacccggaaggtggaggttgcagtgagccaagatcacgccattgcactccagcctgggcaacaagagcaaaattctgtctc

SEQ ID NO: 305175 - DNA, 4473 bp, Homo sapiens
aggaattccggtgagctgagcggcggcggcgcggccgggccggggagcgggcgcggcccggcggcctcagcatggaggacggcttctccagctacagcagcctgtacgacacgtcctcgctgctccagttctgcaacgatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggggtcaggaaagaaactgctgtgccagcaaccaaaagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaagcaaacccaaggagcctgtattcagtgcagaagaaggctatgtaaaaatgtttcttcgtggacgccctgttaccatgtacatgcccaaagatcaagtggattcttacagcttggaagcaaaagtagaacttccaaccaagagactcaagctggaatgggtctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtgcctagcagttcatcctgatcggatcacgatagcaacaggacaagttgcgggcacatcgaaggatggaaaacaattgcccccacatgtgcgcatctgggattctgtgacattgaatactctccacgtcattggaataggtttttttgaccgagcagtcacctgtattgcattctcaaaatctaatggaggaaccaatctctgtgctgtggatgactccaacgaccatgtgctctctgtatgggactggcagaaagaagaaaaactagcagatgtgaagtgctctaatgaagctgtgtttgctgcggatttccaccccacggacaccaacatcatagttacttgtggaaaatcacatctctacttttggacactagaaggaagctcccttaataagaagcaaggattattcgagaaacaagaaaagccaaagtttgtcctctgtgtgactttctctgaaaacggtgacaccattactggagattcaagtggcaacatcttagtatggggaaaaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggagattccagaacagtttggtccaatacggacagtggccgaggggaaaggcgatgtgatcttgattggcacaactcgaaactttgtcctgcagggcactctgtcaggggacttcacacccattactcagggtcacactgatgagctctggggactggccatccatgcctcaaaacctcagttcttgacctgtgggcatgacaagcatgccactctctgggacgctgtgggtcaccgtcccgtctgggacaaaataatagaggatccagctcagtcttctggttttcatccttcagggtctgtggttgcagtcggaacactcactgggaggtggtttgtgtttgacacagaaacaaaagacttggtcaccgttcacacagatggaaacgaacagctctctgtaatgcgatactcaccagatgggaatttcttagccataggctcacatgacaactgcatctatatatatggcgttagtgacaacgggaggaagtacacgcgagtgggcaagtgctcgggtcattccagcttcattactcacctggactggtctgtaaactcacagttcctcgtgtcaaattccggagactacgaaatcctctactgggttccctctgcctgtaagcaagtcgtaagtgtggaaactacaagagacattgaatgggctacctatacctgcactttgggattccatgtttttggagtgtggccagaaggctcggacggaaccgacatcaatgccgtctgtcgggcccatgagaagaaactcctgtcaacaggcgacgactttggcaaagtgcacctcttctcatacccctgctcgcagttcagggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggaatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatgggtcacagaatgccttttaaaacattgtatataatcttcactgtttcaccatctagcttgctaagtcaaatatttatgatgataatgaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacacccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtggatttcttattgacctatattcatgaaagcatataaattaaaatatttaaaattagatatgattcacactatattctgtttcatatgcagattttattctcacctgggccatttgcagatgagactgtagtttgcagatgagactgtagtttgcagatggcgtggaagcattcatcaggggagataaccataaaggatttggcctaattaccatactcaattgtcagtttacgtggttttgtgaatactggcaaaagcaattgtttttaaattaacaatggagagaatgataagatgagggaaggaaaaggcattcattattgacttacatgtcagtaaggtctgcttttatttctatgtactcctgtttgccaagctcaataatggacaaaggatacaaacacacacacatctactattttagataaatgtactgttatatatatatgtaaactactattgctctctttataatgattaatcactttattatgaatgaatgaatgaatttgatggatttaaaaaaaa

SEQ ID NO: 305176 - DNA, 3572 bp, Homo sapiens
gctcaagtgatcctcccacctcagcctcctgagtagctgggagtacaggcacacgccacctcgcccgcaattgcccccacatgtgcgcatctgggattctgtgacattgaatactctccacgtcattggaataggtttttttgaccgagcagtcacctgtattgcattctcaaaatctaatggaggaaccaatctctgtgctgtggatgactccaacgaccatgtgctctctgtatgggactggcagaaagaagaaaaactagcagatgtgaagtgctctaatgaagctgtgtttgctgcggatttccaccccacggacaccaacatcatagttacttgtggaaaatcacatctctacttttggacactagaaggaagctcccttaataagaagcaaggattattcgagaaacaagaaaagccaaagtttgtcctctgtgtgactttctctgaaaacggtgacaccattactggagattcaagtggcaacatcttagtatggggaaaaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggagattccagaacagtttggtccaatacggacagtggccgaggggaaaggcgatgtgatcttgattggcacaactcgaaactttgtcctgcagggcactctgtcaggggacttcacacccattactcagggtcacactgatgagctctggggactggccatccatgcctcaaaacctcagttcttgacctgtgggcatgacaagcatgccactctctgggacgctgtgggtcaccgtcccgtctgggacaaaataatagaggatccagctcagtcttctggttttcatccttcagggtctgtggttgcagtcggaacactcactgggaggtggtttgtgtttgacacagaaacaaaagacttggtcaccgttcacacagatggaaacgaacagctctctgtaatgcgatactcaccagatgggaatttcttagccataggctcacatgacaactgcatctatatatatggcgttagtgacaacgggaggaagtacacgcgagtgggcaagtgctcgggtcattccagcttcattactcacctggactggtctgtaaactcacagttcctcgtgtcaaattccggagactacgaaatcctctactgggttccctctgcctgtaagcaagtcgtaagtgtggaaactacaagagacattgaatgggctacctatacctgcactttgggattccatgtttttggagtgtggccagaaggctcggacggaaccgacatcaatgccgtctgtcgggcccatgagaagaaactcctgtcaacaggcgacgactttggcaaagtgcacctcttctcatacccctgctcgcagttcagggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggaatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatgggtcacagaatgccttttaaaacattgtatataatcttcactgtttcaccatctagcttgctaagtcaaatatttatgatgataatgaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacacccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtggatttcttattgacctatattcatgaaagcatataaattaaaatatttaaaattagatatgattcacactatattctgtttcatatgcagattttattctcacctgggccatttgcagatgagactgtagtttgcagatgagactgtagtttgcagatggcgtggaagcattcatcaggggagataaccataaaggatttggcctaattaccatactcaattgtcagtttacgtggttttgtgaatactggcaaaagcaattgtttttaaattaacaatggagagaatgataagatgagggaaggaaaaggcattcattattgacttacatgtcagtaaggtctgcttttatttctatgtactcctgtttgccaagctcaataatggacaaaggatacaaacacacacacatctactattttagataaatgtactgttatatatatatgtaaactactattgctctctttataatgattaatcactttattatgaatgaatgaatgaatttgatggatttaaaaaaaa

SEQ ID NO: 305177 - DNA, 4160 bp, Homo sapiens
cacttcagaaacccatattcacacacatgtgcacgtgttcacatgaaaagacccccttgcactcaggcccccagagccgaggcattgtgcagccccacagcagccaccttcacagctgctaacagcccctgtgccatgcctgctgcaggcactgtctgctctaggaggggctcttgttttcatggaacccagtggtgaagagacaccccactggcccttctcttccccaattcctgtttcttcattccccatcatttacctgctctttctgtctggtcaagaaagcatgtctcagccaggcccagtggctcagccaggcacagtggctcacaccttctaaccagcactttgggagtctgaagtaggaggattgcttgagcccaggagtttgtgaccagcctgggcaacatagggagatcccatctctacaaataataataataaagagtagctgggagtggtggtacacacccgcggtcccagctacatgggaggctggggtgggaggattgcttgagcctgggaggtcaagggtgcagagagcaatgattgcaccactgcactgtgacctggatgacagagcaaaaccctgtctccagaaaaagaaagaaagaaagaaagcaggtctcaaaagcaatggatgagtattctttaactacaatgtagcagactctttattaaaaatgaaatttgatgtttatttttaatcatgttcaacccactttattctcagatatagtcttcctgtgaataactttcttttcagaatggaggaaccaatctctgtgctgtggatgactccaacgaccatgtgctctctgtatgggactggcagaaagaagaaaaactagcagatgtgaagtgctctaatgaagctgtgtttgctgcggatttccaccccacggacaccaacatcatagttacttgtggaaaatcacatctctacttttggacactagaaggaagctcccttaataagaagcaaggattattcgagaaacaagaaaagccaaagtttgtcctctgtgtgactttctctgaaaacggtgacaccattactggagattcaagtggcaacatcttagtatggggaaaaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggagattccagaacagtttggtccaatacggacagtggccgaggggaaaggcgatgtgatcttgattggcacaactcgaaactttgtcctgcagggcactctgtcaggggacttcacacccattactcagggtcacactgatgagctctggggactggccatccatgcctcaaaacctcagttcttgacctgtgggcatgacaagcatgccactctctgggacgctgtgggtcaccgtcccgtctgggacaaaataatagaggatccagctcagtcttctggttttcatccttcagggtctgtggttgcagtcggaacactcactgggaggtggtttgtgtttgacacagaaacaaaagacttggtcaccgttcacacagatggaaacgaacagctctctgtaatgcgatactcaccagatgggaatttcttagccataggctcacatgacaactgcatctatatatatggcgttagtgacaacgggaggaagtacacgcgagtgggcaagtgctcgggtcattccagcttcattactcacctggactggtctgtaaactcacagttcctcgtgtcaaattccggagactacgaaatcctctactgggttccctctgcctgtaagcaagtcgtaagtgtggaaactacaagagacattgaatgggctacctatacctgcactttgggattccatgtttttggagtgtggccagaaggctcggacggaaccgacatcaatgccgtctgtcgggcccatgagaagaaactcctgtcaacaggcgacgactttggcaaagtgcacctcttctcatacccctgctcgcagttcagggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggaatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatgggtcacagaatgccttttaaaacattgtatataatcttcactgtttcaccatctagcttgctaagtcaaatatttatgatgataatgaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacacccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtggatttcttattgacctatattcatgaaagcatataaattaaaatatttaaaattagatatgattcacactatattctgtttcatatgcagattttattctcacctgggccatttgcagatgagactgtagtttgcagatgagactgtagtttgcagatggcgtggaagcattcatcaggggagataaccataaaggatttggcctaattaccatactcaattgtcagtttacgtggttttgtgaatactggcaaaagcaattgtttttaaattaacaatggagagaatgataagatgagggaaggaaaaggcattcattattgacttacatgtcagtaaggtctgcttttatttctatgtactcctgtttgccaagctcaataatggacaaaggatacaaacacacacacatctactattttagataaatgtactgttatatatatatgtaaactactattgctctctttataatgattaatcactttattatgaatgaatgaatgaatttgatggatttaaaaaaaa

SEQ ID NO: 305178 - DNA, 1644 bp, Homo sapiens
tcggtacccttcatatcgagcgccttcatgccttaaagttacattcgttcttccgctcaaatcctgatctggtccattaaagagtgttcgcagacaaagtttctgaaagattagagaagaatcccccccaagattgcccctacactgcactacagaccaacactattttatttagataaggagacagctttcttaaacgtatacattctctaataaaaatagtttattattttgaatgatttaatggttttctacacaatttacatcacgacatgtaaatcttagcagtaacatctgattctaacagcacatcatgctattcctttcatagagccttcagagattcaatgctaaacaaatttccttagttggcatgaaagccctggacatgaaatcgagtgcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtggatttcttattgacctatattcatgaaagcatataaattaaaatatttaaaattagatatgattcacactatattctgtttcatatgcagattttattctcacctgggccatttgcagatgagactgtagtttgcagatgagactgtagtttgcagatggcgtggaagcattcatcaggggagataaccataaaggatttggcctaattaccatactcaattgtcagtttacgtggttttgtgaatactggcaaaagcaattgtttttaaattaacaatggagagaatgataagatgagggaaggaaaaggcattcattattgacttacatgtcagtaaggtctgcttttatttctatgtactcctgtttgccaagctcaataatggacaaaggatacaaacacacacacatctactattttagataaatgtactgttatatatatatgtaaactactattgctctctttataatgattaatcactttattatgaatgaatgaatgaatttgatggatttaaaaaaaa

SEQ ID NO: 305179 - DNA, 780 bp, Homo sapiens
tactactactaaattcgcggccgcgtcgactactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtggatttcttattgacctatattcatgaaagcatataaattaaaatatttaaaattagatatgattcacactatattctgtttcatatgcagattttattctcacctgggccatttgcagatgagactgtagtttgcagatgagactgtagtttgcagatggcgtggaagcattcatcaggggagataaccataaaggatttggcctaattaccatactcaattgtcagtttacgtggttttgtgaatactggcaaaagcaattgtttttaaattaacaatggagagaatgataagatgagggaaggaaaaggcattcattattgacttacatgtcagtaaggtctgcttttatttctatgtactcctgtttgccaagctcaataatggacaaaggatacaaacacacacacatctactattttagataaatgtactgttatatatatatgtaaactactattgctctctttataatgattaatcactttattatgaatgaatgaatgaatttgatggatttaaaaaaaa

SEQ ID NO: 305180 - DNA, 1102 bp, Homo sapiens
aggaattccggtgagctgagcggcggcggcgcggccgggccggggagcgggcgcggcccggcggcctcagcatggaggacggcttctccagctacagcagcctgtacgacacgtcctcgctgctccagttctgcaacgatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggggtcaggaaagaaactgctgtgccagcaaccaaaagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaagaaaatctaggccgggcgtggtggcccactcctgtaatcctagcacttcagcaggccgaagcgggtggatcacttgagcccaggaattcaagaccagcctggacaacatggcaagaccccatctctacaaaaaatacaaaaattagctgagcgtgttggcacatacctgtagtcccacctacttgagaggctgatgtgggaggattgctcgagcctgggaggctgagactacagtgagctgcgatcataccactgtactccggactgagcaatgggaatgagacccttcctcaaaaaaaaaaaaaaaaaaatctagatgcactaaaaagaagaaacaacaatcacctgcagtctcaccactcagcgaactcacagccaacagtcattacatttccacgtggacttttatttgcagggtgctgtatgagtgtagtgtataattttgacataaatgccattcttgtgcatattttgtgatcccttcttcatttgctaaatgagcatgtctttgtgt

SEQ ID NO: 305181 - DNA, 234 bp, Homo sapiens
caaacccaaggagcctgtattcagtgcaggtaagtctgatttaatttatgtatgggaacccctcactcactctctcagaactcaagggacagaaaagaagtagccagcttcaggggccagccttggacacacaggagctttggtttgtgcaggcccagatggagctttgtacctggaggttgaatggctcagatagtgacagcgagactgcctttaaacagtcataaagagcaa

SEQ ID NO: 305182 - DNA, 823 bp, Homo sapiens
  misc_feature (27)..(27): n is a, c, g, or t
  misc_feature (33)..(33): n is a, c, g, or t
acgatgcaaaaacgcccgtcgggggcncgtctntttcagcagccaatgggctctgcaccttcgtcctcgtcagcattttgtctaatcgcggcctgtgacctcgaaggcggggagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgcagaatggactcctcatctttatattcacgaaaaagcaatctgaagaaaacaaataaaagcctgtgtattta

SEQ ID NO: 305183 - DNA, 753 bp, Homo sapiens
  misc_feature (27)..(27): n is a, c, g, or t
  misc_feature (33)..(33): n is a, c, g, or t
acgatgcaaaaacgcccgtcgggggcncgtctntttcagcagccaatgggctctgcaccttcgtcctcgtcagcattttgtctaatcgcggcctgtgacctcgaaggcggggagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgca

SEQ ID NO: 305184 - DNA, 663 bp, Homo sapiens
  misc_feature (12)..(12): n is a, c, g, or t
gattcggcacgngggggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgcagaatggactcctcatctttatattcacgaaaaagcaatctgaagaaaacaaataaaagcctgtgtattta

SEQ ID NO: 305185 - DNA, 958 bp, Homo sapiens
  misc_feature (27)..(27): n is a, c, g, or t
  misc_feature (33)..(33): n is a, c, g, or t
acgatgcaaaaacgcccgtcgggggcncgtctntttcagcagccaatgggctctgcaccttcgtcctcgtcagcattttgtctaatcgcggcctgtgacctcgaaggcggggagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgcagaatggactcctcatctttatattcacgaaaaagcaatctgaagaaaacaaataaaagcctgtgtatttaacaaaaaaaaaaaaaaaaaattgtggggggggcggcgggaatttaaacatgtgggggggccaggagaaagggacgcgagaacgggggaagggggttcccaaaaccggggggggggaaccagggtgggttgttggc

SEQ ID NO: 305186 - DNA, 700 bp, Homo sapiens
cacgcgtccgcggacgcgtgggggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgcagaatggactcctcatctttatattcacgaaaaagcaatctgaagaaaacaaataaaagcctgtgtattta

SEQ ID NO: 305187 - DNA, 630 bp, Homo sapiens
cacgcgtccgcggacgcgtgggggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgca

SEQ ID NO: 305188 - DNA, 2288 bp, Homo sapiens
  misc_feature (27)..(27): n is a, c, g, or t
  misc_feature (33)..(33): n is a, c, g, or t
acgatgcaaaaacgcccgtcgggggcncgtctntttcagcagccaatgggctctgcaccttcgtcctcgtcagcattttgtctaatcgcggcctgtgacctcgaaggcggggagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgcagaatggactcctcatctttatattcacgaaaaagcaatctgaagaaaacaaataaaagcctgtgtatttagcactgttagtgtcaccttttcaacttctgaaacactgttcattgttaactttttctcatttataaatcactgtatttattttagtagtatgcatagcatatctgtgctcttgaattaatttttatctttaacatatttgtctcatcaatctttaatacactgtgtctaatttgctaccaaatgtaattatcagggtatttataaaaccatagctaacaaaactgagctacaaaatgaaaatttactaaatagtttttaaaatcatggacttcagcctggcgcggtggctcatgcctgtaatcccagcactgtgggaggctgaggcgggcagatcgcctaagttcacgagtttgagaccagcctgcagcatgacgaaacctaaaataacaaaaattagccaggcgtggtagagtgcacctgtaatccctgctactcaggaggcggaggcaggagaatcgcttcaacccgggaggcggaggttgctgtgagcatgccactgcactcctgcctaggcaacagagtgagaccctgtctcaaaaaaataaataaaaccatgggcttccatgctatcttgacaaatttgcactctatagcatcactcaaaatactgcctattggctttaaactccatctgaatactgataactttcacattctttcactagagtggaagctctgagactaggaattttgttgtctttaccccagtcctttgaatagtgactacatgtaagatagtcatgtagtatttattggaaataaatatttattggaaaaacgaaaacagataattcctcttctggtgtttaacacggctttgaaaccaagtgttcaggtgaaagcctttttatattgatttatcagcatttattcaaccccgtttgtcgggaaatgggattacaccgtgtgagccacaatgcccagcctgtaaatttttacacattttaaattctgacaaagtgagggatatgtataatgtatacatatatacaaagtgaggtaaatgtataatgacatttgcattatacagatacatgcaagggttcagtaaagtttggcagcttcctagattgtattgccagtgaatggcagaggcattattaaacctccaccttaccctatagcggggagaccatggcagagtctcagtaggtggttgattgttgttactgatggctcttcctgagcatgtgaaccatggtcctcttctgcctcctagcactgctgctgcaggacttgttcctcgggtcttatcccagagttctggctgcatttgacattcaggtattcttctttgcacttcagatagaatgtaaaacacaggttcttgagtactttatgcttaactcttgtctttgctactcaatagcttatgatcttgagtgaattatgccattttatcccacttcactcacctgtaaaacggggattaaatttttacctccaagagttctttatttagta

SEQ ID NO: 305189 - DNA, 2128 bp, Homo sapiens
  misc_feature (12)..(12): n is a, c, g, or t
gattcggcacgngggggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgcagaatggactcctcatctttatattcacgaaaaagcaatctgaagaaaacaaataaaagcctgtgtatttagcactgttagtgtcaccttttcaacttctgaaacactgttcattgttaactttttctcatttataaatcactgtatttattttagtagtatgcatagcatatctgtgctcttgaattaatttttatctttaacatatttgtctcatcaatctttaatacactgtgtctaatttgctaccaaatgtaattatcagggtatttataaaaccatagctaacaaaactgagctacaaaatgaaaatttactaaatagtttttaaaatcatggacttcagcctggcgcggtggctcatgcctgtaatcccagcactgtgggaggctgaggcgggcagatcgcctaagttcacgagtttgagaccagcctgcagcatgacgaaacctaaaataacaaaaattagccaggcgtggtagagtgcacctgtaatccctgctactcaggaggcggaggcaggagaatcgcttcaacccgggaggcggaggttgctgtgagcatgccactgcactcctgcctaggcaacagagtgagaccctgtctcaaaaaaataaataaaaccatgggcttccatgctatcttgacaaatttgcactctatagcatcactcaaaatactgcctattggctttaaactccatctgaatactgataactttcacattctttcactagagtggaagctctgagactaggaattttgttgtctttaccccagtcctttgaatagtgactacatgtaagatagtcatgtagtatttattggaaataaatatttattggaaaaacgaaaacagataattcctcttctggtgtttaacacggctttgaaaccaagtgttcaggtgaaagcctttttatattgatttatcagcatttattcaaccccgtttgtcgggaaatgggattacaccgtgtgagccacaatgcccagcctgtaaatttttacacattttaaattctgacaaagtgagggatatgtataatgtatacatatatacaaagtgaggtaaatgtataatgacatttgcattatacagatacatgcaagggttcagtaaagtttggcagcttcctagattgtattgccagtgaatggcagaggcattattaaacctccaccttaccctatagcggggagaccatggcagagtctcagtaggtggttgattgttgttactgatggctcttcctgagcatgtgaaccatggtcctcttctgcctcctagcactgctgctgcaggacttgttcctcgggtcttatcccagagttctggctgcatttgacattcaggtattcttctttgcacttcagatagaatgtaaaacacaggttcttgagtactttatgcttaactcttgtctttgctactcaatagcttatgatcttgagtgaattatgccattttatcccacttcactcacctgtaaaacggggattaaatttttacctccaagagttctttatttagta

SEQ ID NO: 305190 - DNA, 2047 bp, Homo sapiens
ccccgggctgcaggattcggcacgaggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgcagaatggactcctcatctttatattcacgaaaaagcaatctgaagaaaacaaataaaagcctgtgtatttagcactgttagtgtcaccttttcaacttctgaaacactgttcattgttaactttttctcatttataaatcactgtatttattttagtagtatgcatagcatatctgtgctcttgaattaatttttatctttaacatatttgtctcatcaatctttaatacactgtgtctaatttgctaccaaatgtaattatcagggtatttataaaaccatagctaacaaaactgagctacaaaatgaaaatttactaaatagtttttaaaatcatggacttcagcctggcgcggtggctcatgcctgtaatcccagcactgtgggaggctgaggcgggcagatcgcctaagttcacgagtttgagaccagcctgcagcatgacgaaacctaaaataacaaaaattagccaggcgtggtagagtgcacctgtaatccctgctactcaggaggcggaggcaggagaatcgcttcaacccgggaggcggaggttgctgtgagcatgccactgcactcctgcctaggcaacagagtgagaccctgtctcaaaaaaataaataaaaccatgggcttccatgctatcttgacaaatttgcactctatagcatcactcaaaatactgcctattggctttaaactccatctgaatactgataactttcacattctttcactagagtggaagctctgagactaggaattttgttgtctttaccccagtcctttgaatagtgactacatgtaagatagtcatgtagtatttattggaaataaatatttattggaaaaacgaaaacagataattcctcttctggtgtttaacacggctttgaaaccaagtgttcaggtgaaagcctttttatattgatttatcagcatttattcaaccccgtttgtcgggaaatgggattacaccgtgtgagccacaatgcccagcctgtaaatttttacacattttaaattctgacaaagtgagggatatgtataatgtatacatatatacaaagtgaggtaaatgtataatgacatttgcattatacagatacatgcaagggttcagtaaagtttggcagcttcctagattgtattgccagtgaatggcagaggcattattaaacctccaccttaccctatagcggggagaccatggcagagtctcagtaggtggttgattgttgttactgatggctcttcctgagcatgtgaaccatggtcctcttctgcctcctagcactgctgctgcaggacttgttcctcgggtcttatcccagagttctggctgcatttgacattcaggtattcttctttgcacttcagatagaatgtaaaacacaggttcttgagtactttatgcttaactcttgtctttgctactcaatagcttatgatcttgagtgaattatgccattttatcccacttcactcacctgtaaaacggggattaaatttttacctccaagagttctttatttagta

SEQ ID NO: 305191 - DNA, 2235 bp, Homo sapiens
  misc_feature (27)..(27): n is a, c, g, or t
  misc_feature (33)..(33): n is a, c, g, or t
acgatgcaaaaacgcccgtcgggggcncgtctntttcagcagccaatgggctctgcaccttcgtcctcgtcagcattttgtctaatcgcggcctgtgacctcgaaggcggggagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaagccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgcagaatggactcctcatctttatattcacgaaaaagcaatctgaagaaaacaaataaaagcctgtgtatttagcactgttagtgtcaccttttcaacttctgaaacactgttcattgttaactttttctcatttataaatcactgtatttattttagtagtatgcatagcatatctgtgctcttgaattaatttttatctttaacatatttgtctcatcaatctttaatacactgtgtctaatttgctaccaaatgtaattatcagggtatttataaaaccatagctaacaaaactgagctacaaaatgaaaatttactaaatagtttttaaaatcatggacttcagcctggcgcggtggctcatgcctgtaatcccagcactgtgggaggctgaggcgggcagatcgcctaagttcacgagtttgagaccagcctgcagcatgacgaaacctaaaataacaaaaattagccaggcgtggtagagtgcacctgtaatccctgctactcaggaggcggaggcaggagaatcgcttcaacccgggaggcggaggttgctgtgagcatgccactgcactcctgcctaggcaacagagtgagaccctgtctcaaaaaaataaataaaaccatgggcttccatgctatcttgacaaatttgcactctatagcatcactcaaaatactgcctattggctttaaactccatctgaatactgataactttcacattctttcactagagtggaagctctgagactaggaattttgttgtctttaccccagtcctttgaatagtgactacatgtaagatagtcatgtagtatttattggaaataaatatttattggaaaaacgaaaacagataattcctcttctggtgtttaacacggctttgaaaccaagtgttcaggtgaaagcctttttatattgatttatcagcatttattcaaccccgtttgtcgggaaatgggattacaccgtgtgagccacaatgcccagcctgtaaatttttacacattttaaattctgacaaagtgagggatatgtataatgtatacatatatacaaagtgaggtaaatgtataatgacatttgcattatacagatacatgcaagggttcagtaaagtttggcagcttcctagattgtattgccagtgaatggcagaggcattattaaacctccaccttaccctatagcggggagaccatggcagagtctcagtaggtggttgattgttgttactgatggctcttcctgagcatgtgaaccatggtcctcttctgcctcctagcactgctgctgcaggacttgttcctcgggtcttatcccagagttctggctgcatttgacattcaggtattcttctttgcacttcagatagaatgtaaaacacaggttcttgagtactttatgcttaactcttgtctttgctactcaatagcttatgatcttgagtgaattatgccattttatcccacttcactcacctgtaaaacggggattaaatttttacctccaagagttctttatttagta

SEQ ID NO: 305192 - DNA, 769 bp, Homo sapiens
  misc_feature (27)..(27): n is a, c, g, or t
  misc_feature (33)..(33): n is a, c, g, or t
acgatgcaaaaacgcccgtcgggggcncgtctntttcagcagccaatgggctctgcaccttcgtcctcgtcagcattttgtctaatcgcggcctgtgacctcgaaggcggggagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactgtatagtttattaaagtattaatatagttttaataagtaaatatttttaggttgcagaatggactcctcatctttatattcacgaaaaagcaatctgaagaaaacaaataaaagcctgtgtattta

SEQ ID NO: 305193 - DNA, 1489 bp, Homo sapiens
aggcgacctagaggaccccttcaggcactgttagtgtcaccttttcaacttctgaaacactgttcattgttaactttttctcatttataaatcactgtatttattttagtagtatgcatagcatatctgtgctcttgaattaatttttatctttaacatatttgtctcatcaatctttaatacactgtgtctaatttgctaccaaatgtaattatcagggtatttataaaaccatagctaacaaaactgagctacaaaatgaaaatttactaaatagtttttaaaatcatggacttcagcctggcgcggtggctcatgcctgtaatcccagcactgtgggaggctgaggcgggcagatcgcctaagttcacgagtttgagaccagcctgcagcatgacgaaacctaaaataacaaaaattagccaggcgtggtagagtgcacctgtaatccctgctactcaggaggcggaggcaggagaatcgcttcaacccgggaggcggaggttgctgtgagcatgccactgcactcctgcctaggcaacagagtgagaccctgtctcaaaaaaataaataaaaccatgggcttccatgctatcttgacaaatttgcactctatagcatcactcaaaatactgcctattggctttaaactccatctgaatactgataactttcacattctttcactagagtggaagctctgagactaggaattttgttgtctttaccccagtcctttgaatagtgactacatgtaagatagtcatgtagtatttattggaaataaatatttattggaaaaacgaaaacagataattcctcttctggtgtttaacacggctttgaaaccaagtgttcaggtgaaagcctttttatattgatttatcagcatttattcaaccccgtttgtcgggaaatgggattacaccgtgtgagccacaatgcccagcctgtaaatttttacacattttaaattctgacaaagtgagggatatgtataatgtatacatatatacaaagtgaggtaaatgtataatgacatttgcattatacagatacatgcaagggttcagtaaagtttggcagcttcctagattgtattgccagtgaatggcagaggcattattaaacctccaccttaccctatagcggggagaccatggcagagtctcagtaggtggttgattgttgttactgatggctcttcctgagcatgtgaaccatggtcctcttctgcctcctagcactgctgctgcaggacttgttcctcgggtcttatcccagagttctggctgcatttgacattcaggtattcttctttgcacttcagatagaatgtaaaacacaggttcttgagtactttatgcttaactcttgtctttgctactcaatagcttatgatcttgagtgaattatgccattttatcccacttcactcacctgtaaaacggggattaaatttttacctccaagagttctttatttagta

SEQ ID NO: 305194 - DNA, 406 bp, Homo sapiens
tggccttgttatcaaaatgtcttttgagaaagattttataacatgtaatatgttgaggttttcacacagatccaaattaataaccagtaactaattattgtaacattttctttcaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgca

SEQ ID NO: 305195 - DNA, 439 bp, Homo sapiens
ctacttgggtagtttaaatagtgatagatccactagtactatttctttgacagataagatccagaggcttacttctaaatgtgaatcctaaattaccaaacatttttgaaatggttaatgagagtgcatctgtttctttattccaagtttaattttcaactggatatctgcactttgtctctgaagaagtatttcctagaggaggaaaaagccttttgatcctttttaataatttacttatgagaagtaatttacataaaatagtagcttatttatgaaaaatagggagggtgtaaggagggagaggagaagaaaaggtaactattggttactgggcttaatatctgggttatgaagtaatgtatacaacaaacgcccatgacgtgtgtttacctgtgtaacaaaccttcacatgtacctcgaaacctcaaataaaagt

SEQ ID NO: 305196 - DNA, 555 bp, Homo sapiens
ggtcaactttgtagtgtgccaactctttgccttgctagcagccatttggtttcgaacttatctacattcaagcaaaactagctcttttataagacatgtagttgctacccttttgggcctttatcttgcacttttttgctttggatggtatgccttacactttcttgtacaaagtggaatttcctactgtatcatgatcatcataggagtggagaacatgcacaattactgctttgtgtttgctctgggatacctcacagtgtgccaagttactcgagtctatatctttgactatggacaatattctgctgatttttcagggtccttgggctaggtcagtctgagtttcctagagaaggcgctcaagagtgcgttttacttctatgcatttcacctattttcagtgttctccattcaacaccagtattcagttgagtagtggaaataatttctggcatttgttccttcaaaggggatgtattttcttcctggtactagatgaatctttttgtcctgtaacaaaactgattatatgtctgttgtgaaataaatgca

SEQ ID NO: 305197 - DNA, 3550 bp, Homo sapiens
ggggcgggcgcgccgctgcatccccatcctcgtcgtcgcccggcacagcgcgagcgggcgagcggcgcgggcggccggagcgccgaggcccggccatggccaccaccagcaccacgggctccaccctgctgcagcccctcagcaacgccgtgcagctgcccatcgaccagttactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagggtgtgttatgaacgaacctccttcagtccaactatccagacgttcattctctctgccatttggcacggggtatacccaggatattatctaacgtttctaacaggggtgttaatgacattagcagcaagagctatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtccccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcgtgtcaatctggatgatagagagaaattaacttttccaaatgaatgtcttgccttaaaccctctatttcctaaaatattgttcctaaatggtattttcaagtgtaatattgtgagaacgctactgcagtagttgatgttgtgtgctgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaaagagaaatcgctaggtaggttactatctggctaatccatttcttatccttgacaatttaattcatatttgggaaacttttagggaaatgaaaaataaaagtcactgagtctgggtgacattttttaagaataatataaattcagtttcaaactcttctcacattaaaattttgctgtgaactcttactaaaatgagttttaggttctgtaagtggaaaaatgtgcttttattttatgggccatttttaccacaactaatcttgccttggattactaagcatctcctgcgatcccacagaggactgtggtggccacaggagctgaaagcagaagagtgggatttgatgccaggcagtggagtggcctcagccccagattgtacctcctgccctgtaggaggggagggggcaaagccttctgacttcacctttgtttgacctatgtatggaacttacttttactttttgccttaaatttttaatgaaatgcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagcatggtggctcacacctgtaatcctagcactttgggaggccgaggtgggcggatcacttgaggtcaggagttggagaccagcctggccaacgtggtgaatccccgtctctactgaaaacacaaaaattagacgggcatggtggcgcacacctgtaatcccagctacttgggaggctgaggcaggagaattgcttgaacctgggaggtggaggttgcagtgagctaaaattgtgccactgcactccagcctgggtgacagaggaagactccgtctcacaaaaaaaa

SEQ ID NO: 305198 - DNA, 3605 bp, Homo sapiens
ggtcaactttgtagtgtgccaactctttgccttgctagcagccatttggtttcgaacttatctacattcaagcaaaactagctcttttataagacatgtagttgctacccttttgggcctttatcttgcacttttttgctttggatggtatgccttacactttcttgtacaaagtggaatttcctactgtatcatgatcatcataggagtggagaacatgcacaattactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagggtgtgttatgaacgaacctccttcagtccaactatccagacgttcattctctctgccatttggcacggggtatacccaggatattatctaacgtttctaacaggggtgttaatgacattagcagcaagagctatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtccccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcgtgtcaatctggatgatagagagaaattaacttttccaaatgaatgtcttgccttaaaccctctatttcctaaaatattgttcctaaatggtattttcaagtgtaatattgtgagaacgctactgcagtagttgatgttgtgtgctgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaaagagaaatcgctaggtaggttactatctggctaatccatttcttatccttgacaatttaattcatatttgggaaacttttagggaaatgaaaaataaaagtcactgagtctgggtgacattttttaagaataatataaattcagtttcaaactcttctcacattaaaattttgctgtgaactcttactaaaatgagttttaggttctgtaagtggaaaaatgtgcttttattttatgggccatttttaccacaactaatcttgccttggattactaagcatctcctgcgatcccacagaggactgtggtggccacaggagctgaaagcagaagagtgggatttgatgccaggcagtggagtggcctcagccccagattgtacctcctgccctgtaggaggggagggggcaaagccttctgacttcacctttgtttgacctatgtatggaacttacttttactttttgccttaaatttttaatgaaatgcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagcatggtggctcacacctgtaatcctagcactttgggaggccgaggtgggcggatcacttgaggtcaggagttggagaccagcctggccaacgtggtgaatccccgtctctactgaaaacacaaaaattagacgggcatggtggcgcacacctgtaatcccagctacttgggaggctgaggcaggagaattgcttgaacctgggaggtggaggttgcagtgagctaaaattgtgccactgcactccagcctgggtgacagaggaagactccgtctcacaaaaaaaa

SEQ ID NO: 305199 - DNA, 3869 bp, Homo sapiens
ggggcgggcgcgccgctgcatccccatcctcgtcgtcgcccggcacagcgcgagcgggcgagcggcgcgggcggccggagcgccgaggcccggccatggccaccaccagcaccacgggctccaccctgctgcagcccctcagcaacgccgtgcagctgcccatcgaccagttactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagggtgtgttatgaacgaacctccttcagtccaactatccagacgttcattctctctgccatttggcacggggtatacccaggatattatctaacgtttctaacaggggtgttaatgacattagcagcaagagctgtaagtatcaagaattttattttacaattcaatggtccacttgaactgttaaaaaggctgagtacatctctcttacaaggtagaccctctttccttggtcgtggtcagtattgtcctttccactagaagcgaggtgtgtactgcgtgcatgtttgctgagcgctcaccacgggctaggctccatgcccagttcctgtgaggagaaaacacgtttctatgtgcccggcaggtaggaggcactcacaaaatgttactttgtctttacagaattttctgaaggagagataaaaactgagttaaataaagatgatcagaatggatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtccccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcgtgtcaatctggatgatagagagaaattaacttttccaaatgaatgtcttgccttaaaccctctatttcctaaaatattgttcctaaatggtattttcaagtgtaatattgtgagaacgctactgcagtagttgatgttgtgtgctgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaaagagaaatcgctaggtaggttactatctggctaatccatttcttatccttgacaatttaattcatatttgggaaacttttagggaaatgaaaaataaaagtcactgagtctgggtgacattttttaagaataatataaattcagtttcaaactcttctcacattaaaattttgctgtgaactcttactaaaatgagttttaggttctgtaagtggaaaaatgtgcttttattttatgggccatttttaccacaactaatcttgccttggattactaagcatctcctgcgatcccacagaggactgtggtggccacaggagctgaaagcagaagagtgggatttgatgccaggcagtggagtggcctcagccccagattgtacctcctgccctgtaggaggggagggggcaaagccttctgacttcacctttgtttgacctatgtatggaacttacttttactttttgccttaaatttttaatgaaatgcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagcatggtggctcacacctgtaatcctagcactttgggaggccgaggtgggcggatcacttgaggtcaggagttggagaccagcctggccaacgtggtgaatccccgtctctactgaaaacacaaaaattagacgggcatggtggcgcacacctgtaatcccagctacttgggaggctgaggcaggagaattgcttgaacctgggaggtggaggttgcagtgagctaaaattgtgccactgcactccagcctgggtgacagaggaagactccgtctcacaaaaaaaa

SEQ ID NO: 305200 - DNA, 3648 bp, Homo sapiens
ggtcaactttgtagtgtgccaactctttgccttgctagcagccatttggtttcgaacttatctacattcaagcaaaactagctcttttataagacatgtagttgctacccttttgggcctttatcttgcacttttttgctttggatggtatgccttacactttcttgtacaaagtggaatttcctactgtatcatgatcatcataggagtggagaacatgcacaattactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatgtaaggtcatgagatttatctggagcctttacagcatgtattgactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagggtgtgttatgaacgaacctccttcagtccaactatccagacgttcattctctctgccatttggcacggggtatacccaggatattatctaacgtttctaacaggggtgttaatgacattagcagcaagagctatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtccccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcgtgtcaatctggatgatagagagaaattaacttttccaaatgaatgtcttgccttaaaccctctatttcctaaaatattgttcctaaatggtattttcaagtgtaatattgtgagaacgctactgcagtagttgatgttgtgtgctgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaaagagaaatcgctaggtaggttactatctggctaatccatttcttatccttgacaatttaattcatatttgggaaacttttagggaaatgaaaaataaaagtcactgagtctgggtgacattttttaagaataatataaattcagtttcaaactcttctcacattaaaattttgctgtgaactcttactaaaatgagttttaggttctgtaagtggaaaaatgtgcttttattttatgggccatttttaccacaactaatcttgccttggattactaagcatctcctgcgatcccacagaggactgtggtggccacaggagctgaaagcagaagagtgggatttgatgccaggcagtggagtggcctcagccccagattgtacctcctgccctgtaggaggggagggggcaaagccttctgacttcacctttgtttgacctatgtatggaacttacttttactttttgccttaaatttttaatgaaatgcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagcatggtggctcacacctgtaatcctagcactttgggaggccgaggtgggcggatcacttgaggtcaggagttggagaccagcctggccaacgtggtgaatccccgtctctactgaaaacacaaaaattagacgggcatggtggcgcacacctgtaatcccagctacttgggaggctgaggcaggagaattgcttgaacctgggaggtggaggttgcagtgagctaaaattgtgccactgcactccagcctgggtgacagaggaagactccgtctcacaaaaaaaa

SEQ ID NO: 305201 - DNA, 3018 bp, Homo sapiens
gagcgtgcttggcttgcacgaggccccgggttcaatccccggtgacctccaccatttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagggtgtgttatgaacgaacctccttcagtccaactatccagacgttcattctctctgccatttggcacggggtatacccaggatattatctaacgtttctaacaggggtgttaatgacattagcagcaagagctatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtccccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcgtgtcaatctggatgatagagagaaattaacttttccaaatgaatgtcttgccttaaaccctctatttcctaaaatattgttcctaaatggtattttcaagtgtaatattgtgagaacgctactgcagtagttgatgttgtgtgctgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaaagagaaatcgctaggtaggttactatctggctaatccatttcttatccttgacaatttaattcatatttgggaaacttttagggaaatgaaaaataaaagtcactgagtctgggtgacattttttaagaataatataaattcagtttcaaactcttctcacattaaaattttgctgtgaactcttactaaaatgagttttaggttctgtaagtggaaaaatgtgcttttattttatgggccatttttaccacaactaatcttgccttggattactaagcatctcctgcgatcccacagaggactgtggtggccacaggagctgaaagcagaagagtgggatttgatgccaggcagtggagtggcctcagccccagattgtacctcctgccctgtaggaggggagggggcaaagccttctgacttcacctttgtttgacctatgtatggaacttacttttactttttgccttaaatttttaatgaaatgcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagcatggtggctcacacctgtaatcctagcactttgggaggccgaggtgggcggatcacttgaggtcaggagttggagaccagcctggccaacgtggtgaatccccgtctctactgaaaacacaaaaattagacgggcatggtggcgcacacctgtaatcccagctacttgggaggctgaggcaggagaattgcttgaacctgggaggtggaggttgcagtgagctaaaattgtgccactgcactccagcctgggtgacagaggaagactccgtctcacaaaaaaaa

SEQ ID NO: 305202 - DNA, 3268 bp, Homo sapiens
tgtaggataaaagcaaccttactctttttgtaaattgtatagactcccaaatactagaaatgatcatttaagttactatatataccaatatatatactatatataccaataagaagatgagaattaactttatgttcctaaatttgacacttaatagctatagcctccctgagatcatagagaagtgattgcctaagataagttgtatttgtttttctagttaccctaaatcctgtcaggtaataaaagaatgatcattgcaggctttgtaaactcgggtcactcactccacttggctctccatgtttttcatggtttctagggtgtgttatgaacgaacctccttcagtccaactatccagacgttcattctctctgccatttggcacggggtatacccaggatattatctaacgtttctaacaggggtgttaatgacattagcagcaagagctgtaagtatcaagaattttattttacaattcaatggtccacttgaactgttaaaaaggctgagtacatctctcttacaaggtagaccctctttccttggtcgtggtcagtattgtcctttccactagaagcgaggtgtgtactgcgtgcatgtttgctgagcgctcaccacgggctaggctccatgcccagttcctgtgaggagaaaacacgtttctatgtgcccggcaggtaggaggcactcacaaaatgttactttgtctttacagaattttctgaaggagagataaaaactgagttaaataaagatgatcagaatggatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtccccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcgtgtcaatctggatgatagagagaaattaacttttccaaatgaatgtcttgccttaaaccctctatttcctaaaatattgttcctaaatggtattttcaagtgtaatattgtgagaacgctactgcagtagttgatgttgtgtgctgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaaagagaaatcgctaggtaggttactatctggctaatccatttcttatccttgacaatttaattcatatttgggaaacttttagggaaatgaaaaataaaagtcactgagtctgggtgacattttttaagaataatataaattcagtttcaaactcttctcacattaaaattttgctgtgaactcttactaaaatgagttttaggttctgtaagtggaaaaatgtgcttttattttatgggccatttttaccacaactaatcttgccttggattactaagcatctcctgcgatcccacagaggactgtggtggccacaggagctgaaagcagaagagtgggatttgatgccaggcagtggagtggcctcagccccagattgtacctcctgccctgtaggaggggagggggcaaagccttctgacttcacctttgtttgacctatgtatggaacttacttttactttttgccttaaatttttaatgaaatgcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagcatggtggctcacacctgtaatcctagcactttgggaggccgaggtgggcggatcacttgaggtcaggagttggagaccagcctggccaacgtggtgaatccccgtctctactgaaaacacaaaaattagacgggcatggtggcgcacacctgtaatcccagctacttgggaggctgaggcaggagaattgcttgaacctgggaggtggaggttgcagtgagctaaaattgtgccactgcactccagcctgggtgacagaggaagactccgtctcacaaaaaaaa

SEQ ID NO: 305203 - DNA, 2522 bp, Homo sapiens
agcaaatgtttttgtttctttatttcagatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtccccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcgtgtcaatctggatgatagagagaaattaacttttccaaatgaatgtcttgccttaaaccctctatttcctaaaatattgttcctaaatggtattttcaagtgtaatattgtgagaacgctactgcagtagttgatgttgtgtgctgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaaagagaaatcgctaggtaggttactatctggctaatccatttcttatccttgacaatttaattcatatttgggaaacttttagggaaatgaaaaataaaagtcactgagtctgggtgacattttttaagaataatataaattcagtttcaaactcttctcacattaaaattttgctgtgaactcttactaaaatgagttttaggttctgtaagtggaaaaatgtgcttttattttatgggccatttttaccacaactaatcttgccttggattactaagcatctcctgcgatcccacagaggactgtggtggccacaggagctgaaagcagaagagtgggatttgatgccaggcagtggagtggcctcagccccagattgtacctcctgccctgtaggaggggagggggcaaagccttctgacttcacctttgtttgacctatgtatggaacttacttttactttttgccttaaatttttaatgaaatgcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagcatggtggctcacacctgtaatcctagcactttgggaggccgaggtgggcggatcacttgaggtcaggagttggagaccagcctggccaacgtggtgaatccccgtctctactgaaaacacaaaaattagacgggcatggtggcgcacacctgtaatcccagctacttgggaggctgaggcaggagaattgcttgaacctgggaggtggaggttgcagtgagctaaaattgtgccactgcactccagcctgggtgacagaggaagactccgtctcacaaaaaaaa

SEQ ID NO: 305204 - DNA, 1992 bp, Homo sapiens
ggggcgggcgcgccgctgcatccccatcctcgtcgtcgcccggcacagcgcgagcgggcgagcggcgcgggcggccggagcgccgaggcccggccatggccaccaccagcaccacgggctccaccctgctgcagcccctcagcaacgccgtgcagctgcccatcgaccagttactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagggtgtgttatgaacgaacctccttcagtccaactatccagacgttcattctctctgccatttggcacggggtatacccaggatattatctaacgtttctaacaggggtgttaatgacattagcagcaagagctatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtccccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcgtgtcaatctggatgatagagagaaattaacttttccaaatgaatgtcttgccttaaaccctctatttcctaaaatattgttcctaaatggtattttcaagtgtaatattgtgagaacgctactgcagtagttgatgttgtgtgctgtaaaggattttaggaggaatttgaaacaggatatttaagagtgtggatatttttaaaatgcaataaacatctcagtatttga

SEQ ID NO: 305205 - DNA, 3094 bp, Homo sapiens
ggggcgggcgcgccgctgcatccccatcctcgtcgtcgcccggcacagcgcgagcgggcgagcggcgcgggcggccggagcgccgaggcccggccatggccaccaccagcaccacgggctccaccctgctgcagcccctcagcaacgccgtgcagctgcccatcgaccagttactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagggtgtgttatgaacgaacctccttcagtccaactatccagacgttcattctctctgccatttggcacggggtatacccaggatattatctaacgtttctaacaggggtgttaatgacattagcagcaagagctatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggtgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaaagagaaatcgctaggtaggttactatctggctaatccatttcttatccttgacaatttaattcatatttgggaaacttttagggaaatgaaaaataaaagtcactgagtctgggtgacattttttaagaataatataaattcagtttcaaactcttctcacattaaaattttgctgtgaactcttactaaaatgagttttaggttctgtaagtggaaaaatgtgcttttattttatgggccatttttaccacaactaatcttgccttggattactaagcatctcctgcgatcccacagaggactgtggtggccacaggagctgaaagcagaagagtgggatttgatgccaggcagtggagtggcctcagccccagattgtacctcctgccctgtaggaggggagggggcaaagccttctgacttcacctttgtttgacctatgtatggaacttacttttactttttgccttaaatttttaatgaaatgcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagcatggtggctcacacctgtaatcctagcactttgggaggccgaggtgggcggatcacttgaggtcaggagttggagaccagcctggccaacgtggtgaatccccgtctctactgaaaacacaaaaattagacgggcatggtggcgcacacctgtaatcccagctacttgggaggctgaggcaggagaattgcttgaacctgggaggtggaggttgcagtgagctaaaattgtgccactgcactccagcctgggtgacagaggaagactccgtctcacaaaaaaaa

SEQ ID NO: 305206 - DNA, 3013 bp, Homo sapiens
ggggcgggcgcgccgctgcatccccatcctcgtcgtcgcccggcacagcgcgagcgggcgagcggcgcgggcggccggagcgccgaggcccggccatggccaccaccagcaccacgggctccaccctgctgcagcccctcagcaacgccgtgcagctgcccatcgaccagttactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagaattttctgaaggagagataaaaactgagttaaataaagatgatcagaatggatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggtgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaaagagaaatcgctaggtaggttactatctggctaatccatttcttatccttgacaatttaattcatatttgggaaacttttagggaaatgaaaaataaaagtcactgagtctgggtgacattttttaagaataatataaattcagtttcaaactcttctcacattaaaattttgctgtgaactcttactaaaatgagttttaggttctgtaagtggaaaaatgtgcttttattttatgggccatttttaccacaactaatcttgccttggattactaagcatctcctgcgatcccacagaggactgtggtggccacaggagctgaaagcagaagagtgggatttgatgccaggcagtggagtggcctcagccccagattgtacctcctgccctgtaggaggggagggggcaaagccttctgacttcacctttgtttgacctatgtatggaacttacttttactttttgccttaaatttttaatgaaatgcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagcatggtggctcacacctgtaatcctagcactttgggaggccgaggtgggcggatcacttgaggtcaggagttggagaccagcctggccaacgtggtgaatccccgtctctactgaaaacacaaaaattagacgggcatggtggcgcacacctgtaatcccagctacttgggaggctgaggcaggagaattgcttgaacctgggaggtggaggttgcagtgagctaaaattgtgccactgcactccagcctgggtgacagaggaagactccgtctcacaaaaaaaa

SEQ ID NO: 305207 - DNA, 1536 bp, Homo sapiens
ggggcgggcgcgccgctgcatccccatcctcgtcgtcgcccggcacagcgcgagcgggcgagcggcgcgggcggccggagcgccgaggcccggccatggccaccaccagcaccacgggctccaccctgctgcagcccctcagcaacgccgtgcagctgcccatcgaccagttactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagggtgtgttatgaacgaacctccttcagtccaactatccagacgttcattctctctgccatttggcacggggtatacccaggatattatctaacgtttctaacaggggtgttaatgacattagcagcaagagctatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggtgtaaaggattttaggaggaatttgaaacaggatatttaagagtgtggatatttttaaaatgcaataaacatctcagtatttga

SEQ ID NO: 305208 - DNA, 1118 bp, Homo sapiens
ggggcgggcgcgccgctgcatccccatcctcgtcgtcgcccggcacagcgcgagcgggcgagcggcgcgggcggccggagcgccgaggcccggccatggccaccaccagcaccacgggctccaccctgctgcagcccctcagcaacgccgtgcagctgcccatcgaccagttactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagggtgtgttatgaacgaacctccttcagtccaactatccagacgttcattctctctgccatttggcacggggtatacccaggatattatctaacgtttctaacaggggtgttaatgacattagcagcaagagctatgagaaataacttagacattatttcattgaaccggatagctgccgaatcctcgagagctac

SEQ ID NO: 305209 - DNA, 2461 bp, Homo sapiens
gagagagggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagaccctcccgttgtctcctgctccccctgctcacgctcggcaccgcgctcgcctccctcggctcggcccaaagcagcagcttcagccccgaagcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctgcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgacagcacgcccttcgatggtgagggcggcttcctggcccatgcctacttcccaggccccaacattggaggagacacccactttgactctgccgagccttggactgtcaggaatgaggatctgaatggaaatgacatcttcctggtggctgtgcacgagctgggccatgccctggggctcgagcattccagtgacccctcggccatcatggcacccttttaccagtggatggacacggagaattttgtgctgcccgatgatgaccgccggggcatccagcaactttatgggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtactaccgtttcaacgaagagctcagggcagtggatagcgagtaccccaagaacatcaaagtctgggaagggatccctgagtctcccagagggtcattcatgggcagcgatgaagtcttcacttacttctacaaggggaacaaatactggaaattcaacaaccagaagctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgttcccatcgtcccgagccccctccccgcagcctccttgcttctctctgtcccctggctggcctccttcaccctgacccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctcccgtcactctgactaaaaagaatcttcagagtgcatatttggaggtggaaagattgttcagttaccctaaagactttgaaagaaagaaagaaagaaag

SEQ ID NO: 305210 - DNA, 4138 bp, Homo sapiens
gagagagggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagaccctcccgttgtctcctgctccccctgctcacgctcggcaccgcgctcgcctccctcggctcggcccaaagcagcagcttcagccccgaagcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctgcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgacagcacgcccttcgatggtgagggcggcttcctggcccatgcctacttcccaggccccaacattggaggagacacccactttgactctgccgagccttggactgtcaggaatgaggatctgaatggaaatgacatcttcctggtggctgtgcacgagctgggccatgccctggggctcgagcattccagtgacccctcggccatcatggcacccttttaccagtggatggacacggagaattttgtgctgcccgatgatgaccgccggggcatccagcaactttatgggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtactaccgtttcaacgaagagctcagggcagtggatagcgagtaccccaagaacatcaaagtctgggaagggatccctgagtctcccagagggtcattcatgggcagcgatgaagtcttcacttacttctacaaggggaacaaatactggaaattcaacaaccagaagctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgttcccatcgtcccgagccccctccccgcagcctccttgcttctctctgtcccctggctggcctccttcaccctgaccgcctccctccctcctgccccggcattgcatcttccctagataggtcccctgagggctgagtgggagggcggccctttccagcctctgcccctcaggggaaccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctctcactactctttctggctaaaaggaatctaatcttgttgagggtagagaccctgagacagtgtgagggggtggggactgccaagccaccctaagaccttgggaggaaaactcagagagggtcttcgttgctcagtcagtcaagttcctcggagatctgcctctgcctcacctaccccagggaacttccaaggaaggagcctgagccactggggactaagtgggcagaagaaacccttggcagccctgtgcctctcgaatgttagccttggatggggctttcacagttagaagagctgaaaccaggggtgcagctgtcaggtagggtggggccggtgggagaggcccgggtcagagccctgggggtgagcctgaaggccacagagaaagaaccttgcccaaactcaggcagctggggctgaggcccaaaggcagaacagccagagggggcaggaggggaccaaaaaggaaaatgaggacgtgcagcagcattggaaggctggggccgggcaggccaggccaagccaagcagggggccacagggtgggctgtggagctctcaggaagggccctgaggaaggcacacttgctcctgttggtccctgtccttgctgcccaggcagcgtggaggggaagggtagggcagccagagaaaggagcagagaaggcacacaaacgaggaatgaggggcttcacgagaggccacagggcctggctggccacgctgtcccggcctgctcaccatctcagtgaggggcaggagctggggctcgcttaggctgggtccacgcttccctggtgccagcacccctcaagcctgtctcaccagtggcctgccctctcgctcccccacccagcccacccattgaagtctccttgggccaccaaaggtggtggccatggtaccggggacttgggagagtgagacccagtggagggagcaagaggagagggatgtcgggggggtggggcacggggtaggggaaatggggtgaacggtgctggcagttcggctagatttctgtcttgtttgtttttttgttttgtttaatgtatatttttattataattattatatatgaattccattcaaatcgttcctttttgttaacaaggggcatggggaggggtgggggtgggggggcagaggaggcgtctgaccccaggaacctgcagggcggggctgggtcggtgccctctaaggacaattttgaccttgttcaacctttccacaaagaataaattgtgtttcacaaaaaaaaaaaaaaaaaaaaatggaaaaaaaacaaaaaaaaaaaaaacaaaaaaaaaaaacaaacacaaggaaacaaagaagaacaaaaaagaaaaaagagacaaaaaaaaaaaaagagaggaggcggggcgcgacacatacaactaatggcgggggaggaagaaccccccaaaaaagaggggccggagagtgccgtgtacaagacaagaacagcgcagggcggcgctgaacaacaagtgcgtgagcgagtagaaagcagcgctgcgtgacactatggaggaaaaaaaactccattgggggagtgcagcaacacgggacaccccacacagcacagaaatcacggaggaaaacaaaacaaccgagggtctagtgagaaaagacagtgagcgcgagaaaaaggcgcggggatcataatatacga

SEQ ID NO: 305211 - DNA, 3717 bp, Homo sapiens
gagagagggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagaccctcccgttgtctcctgctccccctgctcacgctcggcaccgcgctcgcctccctcggctcggcccaaagcagcagcttcagccccgaagcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctgcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgacagcacgcccttcgatggtgagggcggcttcctggcccatgcctacttcccaggccccaacattggaggagacacccactttgactctgccgagccttggactgtcaggaatgaggatctgaatggaaatgacatcttcctggtggctgtgcacgagctgggccatgccctggggctcgagcattccagtgacccctcggccatcatggcacccttttaccagtggatggacacggagaattttgtgctgcccgatgatgaccgccggggcatccagcaactttatgggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtactaccgtttcaacgaagagctcagggcagtggatagcgagtaccccaagaacatcaaagtctgggaagggatccctgagtctcccagagggtcattcatgggcagcgatgaagtcttcacttacttctacaaggggaacaaatactggaaattcaacaaccagaagctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgttcccatcgtcccgagccccctccccgcagcctccttgcttctctctgtcccctggctggcctccttcaccctgaccgcctccctccctcctgccccggcattgcatcttccctagataggtcccctgagggctgagtgggagggcggccctttccagcctctgcccctcaggggaaccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctctcactactctttctggctaaaaggaatctaatcttgttgagggtagagaccctgagacagtgtgagggggtggggactgccaagccaccctaagaccttgggaggaaaactcagagagggtcttcgttgctcagtcagtcaagttcctcggagatctgcctctgcctcacctaccccagggaacttccaaggaaggagcctgagccactggggactaagtgggcagaagaaacccttggcagccctgtgcctctcgaatgttagccttggatggggctttcacagttagaagagctgaaaccaggggtgcagctgtcaggtagggtggggccggtgggagaggcccgggtcagagccctgggggtgagcctgaaggccacagagaaagaaccttgcccaaactcaggcagctggggctgaggcccaaaggcagaacagccagagggggcaggaggggaccaaaaaggaaaatgaggacgtgcagcagcattggaaggctggggccgggcaggccaggccaagccaagcagggggccacagggtgggctgtggagctctcaggaagggccctgaggaaggcacacttgctcctgttggtccctgtccttgctgcccaggcagcgtggaggggaagggtagggcagccagagaaaggagcagagaaggcacacaaacgaggaatgaggggcttcacgagaggccacagggcctggctggccacgctgtcccggcctgctcaccatctcagtgaggggcaggagctggggctcgcttaggctgggtccacgcttccctggtgccagcacccctcaagcctgtctcaccagtggcctgccctctcgctcccccacccagcccacccattgaagtctccttgggccaccaaaggtggtggccatggtaccggggacttgggagagtgagacccagtggagggagcaagaggagagggatgtcgggggggtggggcacggggtaggggaaatggggtgaacggtgctggcagttcggctagatttctgtcttgtttgtttttttgttttgtttaatgtatatttttattataattattatatatgaattccattcaaatcgttcctttttgttaacaaggggcatggggaggggtgggggtgggggggcagaggaggcgtctgaccccaggaacctgcagggcggggctgggtcggtgccctctaaggacaattttgaccttgttcaacctttccacaaagaataaattgtgtttcaca

SEQ ID NO: 305212 - DNA, 3395 bp, Homo sapiens
gagagagggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagaccctcccgttgtctcctgctccccctgctcacgctcggcaccgcgctcgcctccctcggctcggcccaaagcagcagcttcagccccgaagcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctgcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgacagcacgcccttcgatggtgagggcggcttcctggcccatgcctacttcccaggccccaacattggaggagacacccactttgactctgccgagccttggactgtcaggaatgaggatctgaatggaaatgacatcttcctggtggctgtgcacgagctgggccatgccctggggctcgagcattccagtgacccctcggccatcatggcacccttttaccagtggatggacacggagaattttgtgctgcccgatgatgaccgccggggcatccagcaactttatgggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtactaccgtttcaacgaagagctcagggcagtggatagcgagtaccccaagaacatcaaagtctgggaagggatccctgagtctcccagagggtcattcatgggcagcgatgaagtcttcacttacttctacaaggggaacaaatactggaaattcaacaaccagaagctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgttcccatcgtcccgagccccctccccgcagcctccttgcttctctctgtcccctggctggcctccttcaccctgaccgcctccctccctcctgccccggcattgcatcttccctagataggtcccctgagggctgagtgggagggcggccctttccagcctctgcccctcaggggaaccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctctcactactctttctggctaaaaggaatctaatcttgttgagggtagagaccctgagacagtgtgagggggtggggactgccaagccaccctaagaccttgggaggaaaactcagagagggtcttcgttgctcagtcagtcaagttcctcggagatctgcctctgcctcacctaccccagggaacttccaaggaaggagcctgagccactggggactaagtgggcagaagaaacccttggcagccctgtgcctctcgaatgttagccttggatggggctttcacagttagaagagctgaaaccaggggtgcagctgtcaggtagggtggggccggtgggagaggcccgggtcagagccctgggggtgagcctgaaggccacagagaaagaaccttgcccaaactcaggcagctggggctgaggcccaaaggcagaacagccagagggggcaggaggggaccaaaaaggaaaatgaggacgtgcagcagcattggaaggctggggccgggcaggccaggccaagccaagcagggggccacagggtgggctgtggagctctcaggaagggccctgaggaaggcacacttgctcctgttggtccctgtccttgctgcccaggcagcgtggaggggaagggtagggcagccagagaaaggagcagagaaggcacacaaacgaggaatgaggggcttcacgagaggccacagggcctggctggccacgctgtcccggcctgctcaccatctcagtgaggggcaggagctggggctcgcttaggctgggtccacgcttccctggtgccagcacccctcaagcctgtctcaccaaggcgtctgaccccaggaacctgcagggcggggctgggtcggtgccctctaaggacaattttgaccttgttcaacctttccacaaagaataaattgtgtttcaca

SEQ ID NO: 305213 - DNA, 3312 bp, Homo sapiens
gagagagggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagaccctcccgttgtctcctgctccccctgctcacgctcggcaccgcgctcgcctccctcggctcggcccaaagcagcagcttcagccccgaagcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctgcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgacagcacgcccttcgatggtgagggcggcttcctggcccatgcctacttcccaggccccaacattggaggagacacccactttgactctgccgagccttggactgtcaggaatgaggatctgaatggaaatgacatcttcctggtggctgtgcacgagctgggccatgccctggggctcgagcattccagtgacccctcggccatcatggcacccttttaccagtggatggacacggagaattttgtgctgcccgatgatgaccgccggggcatccagcaactttatgggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtactaccgtttcaacgaagagctcagggcagtggatagcgagtaccccaagaacatcaaagtctgggaagggatccctgagtctcccagagggtcattcatgggcagcgatgaagtcttcacttacttctacaaggggaacaaatactggaaattcaacaaccagaagctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgttcccatcgtcccgagccccctccccgcagcctccttgcttctctctgtcccctggctggcctccttcaccctgaccgcctccctccctcctgccccggcattgcatcttccctagataggtcccctgagggctgagtgggagggcggccctttccagcctctgcccctcaggggaaccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctctcactactctttctggctaaaaggaatctaatcttgttgagggtagagaccctgagacagtgtgagggggtggggactgccaagccaccctaagaccttgggaggaaaactcagagagggtcttcgttgctcagtcagtcaagttcctcggagatctgcctctgcctcacctaccccagggaacttccaaggaaggagcctgagccactggggactaagtgggcagaagaaacccttggcagccctgtgcctctcgaatgttagccttggatggggctttcacagttagaagagctgaaaccaggggtgcagctgtcaggtagggtggggccggtgggagaggcccgggtcagagccctgggggtgagcctgaaggccacagagaaagaaccttgcccaaactcaggcagctggggctgaggcccaaaggcagaacagccagagggggcaggaggggaccaaaaaggaaaatgaggacgtgcagcagcattggaaggctggggccgggcaggccaggccaagccaagcagggggccacagggtgggctgtggagctctcaggaagggccctgaggaaggcacacttgctcctgttggtccctgtccttgctgcccaggcagcgtggaggggaagggtagggcagccagagaaaggagcagagaaggcacacaaacgaggaatgaggggcttcacgagaggccacagggcctggctggccacgctgtcccggcctgctcaccatctcagtgaggggcaggagctggggctcgcttaggtgggtcggtgccctctaaggacaattttgaccttgttcaacctttccacaaagaataaattgtgtttcaca

SEQ ID NO: 305214 - DNA, 2718 bp, Homo sapiens
gagagagggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagaccctcccgttgtctcctgctccccctgctcacgctcggcaccgcgctcgcctccctcggctcggcccaaagcagcagcttcagccccgaagcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctgcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgacagcacgcccttcgatggtgagggcggcttcctggcccatgcctacttcccaggccccaacattggaggagacacccactttgactctgccgagccttggactgtcaggaatgaggatctgaatggaaatgacatcttcctggtggctgtgcacgagctgggccatgccctggggctcgagcattccagtgacccctcggccatcatggcacccttttaccagtggatggacacggagaattttgtgctgcccgatgatgaccgccggggcatccagcaactttatgggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtactaccgtttcaacgaagagctcagggcagtggatagcgagtaccccaagaacatcaaagtctgggaagggatccctgagtctcccagagggtcattcatgggcagcgatgaagtcttcacttacttctacaaggggaacaaatactggaaattcaacaaccagaagctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgttcccatcgtcccgagccccctccccgcagcctccttgcttctctctgtcccctggctggcctccttcaccctgaccgcctccctccctcctgccccggcattgcatcttccctagataggtcccctgagggctgagtgggagggcggccctttccagcctctgcccctcaggggaaccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctctcactactctttctggctaaaaggaatctaatcttgttgagggtagagaccctgagacagtgtgagggggtggggactgccaagccaccctaagaccttgggaggaaaactcagagagggtcttcgttgctcagtcagtcaagttcctcaggcgtctgaccccaggaacctgcagggcggggctgggtcggtgccctctaaggacaattttgaccttgttcaacctttccacaaagaataaattgtgtttcaca

SEQ ID NO: 305215 - DNA, 2683 bp, Homo sapiens
gagagagggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagaccctcccgttgtctcctgctccccctgctcacgctcggcaccgcgctcgcctccctcggctcggcccaaagcagcagcttcagccccgaagcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctgcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgacagcacgcccttcgatggtgagggcggcttcctggcccatgcctacttcccaggccccaacattggaggagacacccactttgactctgccgagccttggactgtcaggaatgaggatctgaatggaaatgacatcttcctggtggctgtgcacgagctgggccatgccctggggctcgagcattccagtgacccctcggccatcatggcacccttttaccagtggatggacacggagaattttgtgctgcccgatgatgaccgccggggcatccagcaactttatgggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtactaccgtttcaacgaagagctcagggcagtggatagcgagtaccccaagaacatcaaagtctgggaagggatccctgagtctcccagagggtcattcatgggcagcgatgaagtcttcacttacttctacaaggggaacaaatactggaaattcaacaaccagaagctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgttcccatcgtcccgagccccctccccgcagcctccttgcttctctctgtcccctggctggcctccttcaccctgaccgcctccctccctcctgccccggcattgcatcttccctagataggtcccctgagggctgagtgggagggcggccctttccagcctctgcccctcaggggaaccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctctcactactctttctggctaaaaggaatctaatcttgttgagggtagagaccctgagacagtgtgagggggtggggactgccaagccaccctaagaccttgggaggaaaactcagaggcgtctgaccccaggaacctgcagggcggggctgggtcggtgccctctaaggacaattttgaccttgttcaacctttccacaaagaataaattgtgtttcaca

SEQ ID NO: 305216 - DNA, 3985 bp, Homo sapiens
gctctagaggaattatgtcatcccccttcgtgggcctgactattccccataatcactgaccagcttgacactccccttgcaaacatcccagcactgaccccaggcagcactcctagccttggctttggcatgagatggagtgctccttattccccatctggtccagttccttcacttacagatggcagcagtgaggccttggggtagaaggatcctccaaagtcacacagagtgcctgcctcctggtcccctcagctctgcctctggagcccactgcctgcccagtgccatcaggatgagcagtcccggccaagcataatgacaggcaaagctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctgcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgacagcacgcccttcgatggtgagggcggcttcctggcccatgcctacttcccaggccccaacattggaggagacacccactttgactctgccgagccttggactgtcaggaatgaggatctgaatggaaatgacatcttcctggtggctgtgcacgagctgggccatgccctggggctcgagcattccagtgacccctcggccatcatggcacccttttaccagtggatggacacggagaattttgtgctgcccgatgatgaccgccggggcatccagcaactttatgggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtactaccgtttcaacgaagagctcagggcagtggatagcgagtaccccaagaacatcaaagtctgggaagggatccctgagtctcccagagggtcattcatgggcagcgatgaagtcttcacttacttctacaaggggaacaaatactggaaattcaacaaccagaagctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgttcccatcgtcccgagccccctccccgcagcctccttgcttctctctgtcccctggctggcctccttcaccctgaccgcctccctccctcctgccccggcattgcatcttccctagataggtcccctgagggctgagtgggagggcggccctttccagcctctgcccctcaggggaaccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctctcactactctttctggctaaaaggaatctaatcttgttgagggtagagaccctgagacagtgtgagggggtggggactgccaagccaccctaagaccttgggaggaaaactcagagagggtcttcgttgctcagtcagtcaagttcctcggagatctgcctctgcctcacctaccccagggaacttccaaggaaggagcctgagccactggggactaagtgggcagaagaaacccttggcagccctgtgcctctcgaatgttagccttggatggggctttcacagttagaagagctgaaaccaggggtgcagctgtcaggtagggtggggccggtgggagaggcccgggtcagagccctgggggtgagcctgaaggccacagagaaagaaccttgcccaaactcaggcagctggggctgaggcccaaaggcagaacagccagagggggcaggaggggaccaaaaaggaaaatgaggacgtgcagcagcattggaaggctggggccgggcaggccaggccaagccaagcagggggccacagggtgggctgtggagctctcaggaagggccctgaggaaggcacacttgctcctgttggtccctgtccttgctgcccaggcagcgtggaggggaagggtagggcagccagagaaaggagcagagaaggcacacaaacgaggaatgaggggcttcacgagaggccacagggcctggctggccacgctgtcccggcctgctcaccatctcagtgaggggcaggagctggggctcgcttaggctgggtccacgcttccctggtgccagcacccctcaagcctgtctcaccagtggcctgccctctcgctcccccacccagcccacccattgaagtctccttgggccaccaaaggtggtggccatggtaccggggacttgggagagtgagacccagtggagggagcaagaggagagggatgtcgggggggtggggcacggggtaggggaaatggggtgaacggtgctggcagttcggctagatttctgtcttgtttgtttttttgttttgtttaatgtatatttttattataattattatatatgaattccattcaaatcgttcctttttgttaacaaggggcatggggaggggtgggggtgggggggcagaggaggcgtctgaccccaggaacctgcagggcggggctgggtcggtgccctctaaggacaattttgaccttgttcaacctttccacaaagaataaattgtgtttcacaaaaaaaaaaaaaaaaaaaaatggaaaaaaaacaaaaaaaaaaaaaacaaaaaaaaaaaacaaacacaaggaaacaaagaagaacaaaaaagaaaaaagagacaaaaaaaaaaaaagagaggaggcggggcgcgacacatacaactaatggcgggggaggaagaaccccccaaaaaagaggggccggagagtgccgtgtacaagacaagaacagcgcagggcggcgctgaacaacaagtgcgtgagcgagtagaaagcagcgctgcgtgacactatggaggaaaaaaaactccattgggggagtgcagcaacacgggacaccccacacagcacagaaatcacggaggaaaacaaaacaaccgagggtctagtgagaaaagacagtgagcgcgagaaaaaggcgcggggatcataatatacga

SEQ ID NO: 305217 - DNA, 3367 bp, Homo sapiens
tcagctcggtccgctttggatgcggctattagccagaaagagtatgagaggctgcaattgggtacacctggggctttcaggtctggagtgcccagagcctcctgaggtcagagttcagaggttaaggtatgtcagggtctctaccctcaacaagattagattccttttagccagaaagagtagtgagaggctgccaattgggtacacctggggctcgagcattccagtgacccctcggccatcatggcacccttttaccagtggatggacacggagaattttgtgctgcccgatgatgaccgccggggcatccagcaactttatgggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtactaccgtttcaacgaagagctcagggcagtggatagcgagtaccccaagaacatcaaagtctgggaagggatccctgagtctcccagagggtcattcatgggcagcgatgaagtcttcacttacttctacaaggggaacaaatactggaaattcaacaaccagaagctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgttcccatcgtcccgagccccctccccgcagcctccttgcttctctctgtcccctggctggcctccttcaccctgaccgcctccctccctcctgccccggcattgcatcttccctagataggtcccctgagggctgagtgggagggcggccctttccagcctctgcccctcaggggaaccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctctcactactctttctggctaaaaggaatctaatcttgttgagggtagagaccctgagacagtgtgagggggtggggactgccaagccaccctaagaccttgggaggaaaactcagagagggtcttcgttgctcagtcagtcaagttcctcggagatctgcctctgcctcacctaccccagggaacttccaaggaaggagcctgagccactggggactaagtgggcagaagaaacccttggcagccctgtgcctctcgaatgttagccttggatggggctttcacagttagaagagctgaaaccaggggtgcagctgtcaggtagggtggggccggtgggagaggcccgggtcagagccctgggggtgagcctgaaggccacagagaaagaaccttgcccaaactcaggcagctggggctgaggcccaaaggcagaacagccagagggggcaggaggggaccaaaaaggaaaatgaggacgtgcagcagcattggaaggctggggccgggcaggccaggccaagccaagcagggggccacagggtgggctgtggagctctcaggaagggccctgaggaaggcacacttgctcctgttggtccctgtccttgctgcccaggcagcgtggaggggaagggtagggcagccagagaaaggagcagagaaggcacacaaacgaggaatgaggggcttcacgagaggccacagggcctggctggccacgctgtcccggcctgctcaccatctcagtgaggggcaggagctggggctcgcttaggctgggtccacgcttccctggtgccagcacccctcaagcctgtctcaccagtggcctgccctctcgctcccccacccagcccacccattgaagtctccttgggccaccaaaggtggtggccatggtaccggggacttgggagagtgagacccagtggagggagcaagaggagagggatgtcgggggggtggggcacggggtaggggaaatggggtgaacggtgctggcagttcggctagatttctgtcttgtttgtttttttgttttgtttaatgtatatttttattataattattatatatgaattccattcaaatcgttcctttttgttaacaaggggcatggggaggggtgggggtgggggggcagaggaggcgtctgaccccaggaacctgcagggcggggctgggtcggtgccctctaaggacaattttgaccttgttcaacctttccacaaagaataaattgtgtttcacaaaaaaaaaaaaaaaaaaaaatggaaaaaaaacaaaaaaaaaaaaaacaaaaaaaaaaaacaaacacaaggaaacaaagaagaacaaaaaagaaaaaagagacaaaaaaaaaaaaagagaggaggcggggcgcgacacatacaactaatggcgggggaggaagaaccccccaaaaaagaggggccggagagtgccgtgtacaagacaagaacagcgcagggcggcgctgaacaacaagtgcgtgagcgagtagaaagcagcgctgcgtgacactatggaggaaaaaaaactccattgggggagtgcagcaacacgggacaccccacacagcacagaaatcacggaggaaaacaaaacaaccgagggtctagtgagaaaagacagtgagcgcgagaaaaaggcgcggggatcataatatacga

SEQ ID NO: 305218 - DNA, 2389 bp, Homo sapiens
gagagagggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagaccctcccgttgtctcctgctccccctgctcacgctcggcaccgcgctcgcctccctcggctcggcccaaagcagcagcttcagccccgaagcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctgcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgacagcacgcccttcgatggtgagggcggcttcctggcccatgcctacttcccaggccccaacattggaggagacacccactttgactctgccgagccttggactgtcaggaatgaggatctgaatggaaatgacatcttcctggtggctgtgcacgagctgggccatgccctggggctcgagcattccagtgacccctcggccatcatggcacccttttaccagtggatggacacggagaattttgtgctgcccgatgatgaccgccggggcatccagcaactttatgggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtactaccgtttcaacgaagagctcagggcagtggatagcgagtaccccaagaacatcaaagtctgggaagggatccctgagtctcccagagggtcattcatgggcagcgatgaagtcttcacttacttctacaaggggaacaaatactggaaattcaacaaccagaagctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgttcccatcgtcccgagccccctccccgcagcctccttgcttctctctgtcccctggctggcctccttcaccctgaccgcctccctccctcctgccccggcattgcatcttccctagataggtcccctgagggctgagtgggagggcggccctttccagcctctgcccctcaggggaaccctgtagctttgtgtctgtccagccccataggcgtctgaccccaggaacctgcagggcggggctgggtcggtgccctctaaggacaattttgaccttgttcaacctttccacaaagaataaattgtgtttcaca

SEQ ID NO: 305219 - DNA, 188 bp, Homo sapiens
ggcaacataatgaaatcactttctggtgagtccaacaggcaagcaacctttctcacatctggttattatttcctacccattgtgcttatgcagggactcagagaccccctgccccactcccctcagttcctgggaagcatccgtgggagtggggaggaaaatggctctcatccttgagagaggtgtag

SEQ ID NO: 305220 - DNA, 3722 bp, Homo sapiens
gcgggcgggcgcgcggaccccgcggctatgaagtggcccccgggggcccggagcccgacagtccccggggagggagccgcacgcggcccagggcagcggtctaggggcgccggggccggggcgtaggggccgttgcccgcgatggaccgcaccggagacgctccggactcgtcgccgcaggtgtccaccccccagggttcctgacccctgcccctggacagcgaccccttctcagactccagttgggccggactctccaaacctgcttccgcaatgggtgggttgtgagtgctggtaagacctgctagccaacattcagctgctctgtcctctccatgcctggccggcccggcccatgcctgttcttttctcccctgtgctgccgccgcccgtggccgcccctctcctgaacttaccgccactcaggtaatgaggagccgtgggtgcagccagccttggagatgccgaagagacgggacatcctagcgatcgtcctcatcgtgctgccctggactctgctcatcactgtctggcaccagagcaccctcgcacccctgctcgcggtacataaggatgagggcagtgacccccgacgcgaaacgccgcccggcgccgaccccagggagtactgcacgtctgaccgcgacatcgtggaggtggtgcgcaccgagtacgtgtacacgcggcccccgccatggtccgacacgctgcccaccatccacgtggtgacgcccacctacagccgcccggtgcagaaggccgagctgacgcgcatggccaacacgctgctgcacgtgcccaacctccactggctggtggtggaggatgcgccgcgccggacgccgctgaccgcgcgcctgctgcgcgacaccggcctcaactacacgcacctgcacgtggagacgccccgcaactacaagctgcgcggagacgcccgcgacccacgcatcccgcggggcaccatgcagcgcaacctggccctgcgctggctgcgcgagaccttcccgcgcaactccagccagcctggcgtggtctacttcgccgacgacgacaacacctacagcctggagctcttcgaagagatgcgcagcaccaggagggtgtccgtgtggcccgtcgccttcgtgggtggcctgcggtacgaggccccacgggtgaacggggcagggaaggtggtcggctggaagacggtgtttgacccccaccggccatttgcaatagacatggctggatttgccgtcaacctgcggctcattctgcagcgaagccaggcctacttcaagctgcgaggtgtgaagggaggctaccaggaaagcagcctccttcgagaacttgtcaccctcaacgacctggagcccaaggcagccaactgcaccaagatcctggtgtggcacacacggacagagaagccagtgctggtgaatgagggcaagaagggcttcactgacccctcggtggagatctgagcctcaggatgcaggagcctcctcctcagaccctgttcttggccttccatcctctccccacggctgatggtccctccaaggccgactcctaaggaatcaccatcaccctcctttctattctgggggcttctgagagagcccagcctgatgccagaacaaaggacagagaatttaagcacagaaatcccagacctgttgttctctccatccagcgtgaccagggcccgagagacctgatggccagggtggggtgtccagcaccagccaagctggtgcccagcgcacctccccagagctccccgcactgacggggctgcaggagcaggtgcagtgggcgcccacactggccctgcagtgatgcagggcgggagggagataagaagaccccgcagtcaagtggagcatggccctccctggctccctgtccctgggctcagcacgaccacacaggacacccagccagggaattctgaagaccagagagcagcccacgggcatcacgagcgctctgctcctctcctgggcccctgctcttcccgagagctgcccccaaatcagacatacctctgtggctctcctctggttcacgtttacagagcataaggctgtcttggatcccaacaggcacccagccctgcatggggggagcctgggcctaataggcaccccctgtacctcaggctgtggcgggagcagagtccccccctccggcccctcttcctttaccccttctcctccagcagtggcaaaggggtaggctctagagccagcacaggtcactgcctgacctggactaagaaccccacggccccactgtccacacactgcctccccaccgcccacctcggctgctaggcccctcgcctggactggactggggagggaaagcgccttttcctgcagctcttcagagccacagacctcagggtggagtgagcccatggtgggcagtgggcaaggcggtgggtggtgggcaaggtgggacctcctgcagcctggaaagaggagggaggccaaggccattccctaactccctcctgcccctggtctgaggaggagggactctggagtagcagaggggctgggaaagagggggcaggggctgctgggacactgagcaggagggaggcctgagcacactgctttggaaattattctaaacacaaaaaagggaaagaaaatgttatttctccctaagtcaggagcatgcagagctagcccacctcatgtccagctgtccactttccatcctggagaaagaacagtgtgcctcaaactcctgccctccccaggcctctggggcccactggaaagggctctgaccccctggcccagccgggctctctagtggtgatccggctcattctcctgcaagttggaagcacaattttccccccaagtggaggaaaaggaaagggccccagcctactgaagaggtgtttattttttaactaacagcctcccaccccattaagactcaccaggagaggtctgagggccattcagaacccactcctgagtgggtgggtgggtgggactcagtccagagacctaacattcagaatatagcattggttgcctattttgagatggatttaatctcccacagtattcatgagaccatctgatggaatcagatccctgagccaccttgcaggacgttttccccaacctcttacaccctggatgtcactttggaaaccaagcccttggaagcaagtggggtggcatgggagagaagggaggaggtgggcacaggtggtgagcttatgtgtgggcactctactgcctcacagaagccagccaagtgccaaggtcagcttggctggtctgaggccaccttcttagccaaaaacctagggttcattttcaggactttgataatgaacaacaaaatggggacttctttgggcagatgctaggtcagttgttttcacctaatatcctcttttagctgcatgtatatttatttataattataaccctggtggactgcagccttcatctttattgggaatgagtttgttataaatcagaaatgggtccatgatgaccactgttttccaaacccagtctgttccctgctccctcgctggcaagccccaccacacaggagtgaggccaggggctaggagttctaagaacagaggctggggtgagggtggcacccaggcagctgcatctggtctgttttaatttaactgtatttaatttgctttcaaaattaaaagtcaaatacagtttttaacagtccta

SEQ ID NO: 305221 - DNA, 1272 bp, Homo sapiens
tgtgtttagaataatttccaaagcagtggccaaggccattccctaactccctcctgcccctggtctgaggaggagggactctggagtagcagaggggctgggaaagagggggcaggggctgctgggacactgagcaggagggaggcctgagcacactgctttggaaattattctaaacacaaaaaagggaaagaaaatgttatttctccctaagtcaggagcatgcagagctagcccacctcatgtccagctgtccactttccatcctggagaaagaacagtgtgcctcaaactcctgccctccccaggcctctggggcccactggaaagggctctgaccccctggcccagccgggctctctagtggtgatccggctcattctcctgcaagttggaagcacaattttccccccaagtggaggaaaaggaaagggccccagcctactgaagaggtgtttattttttaactaacagcctcccaccccattaagactcaccaggagaggtctgagggccattcagaacccactcctgagtgggtgggtgggtgggactcagtccagagacctaacattcagaatatagcattggttgcctattttgagatggatttaatctcccacagtattcatgagaccatctgatggaatcagatccctgagccaccttgcaggacgttttccccaacctcttacaccctggatgtcactttggaaaccaagcccttggaagcaagtggggtggcatgggagagaagggaggaggtgggcacaggtggtgagcttatgtgtgggcactctactgcctcacagaagccagccaagtgccaaggtcagcttggctggtctgaggccaccttcttagccaaaaacctagggttcattttcaggactttgataatgaacaacaaaatggggacttctttgggcagatgctaggtcagttgttttcacctaatatcctcttttagctgcatgtatatttatttataattataaccctggtggactgcagccttcatctttattgggaatgagtttgttataaatcagaaatgggtccatgatgaccactgttttccaaacccagtctgttccctgctccctcgctggcaagccccaccacacaggagtgaggccaggggctaggagttctaagaacagaggctggggtgagggtggcacccaggcagctgcatctggtctgttttaatttaactgtatttaatttgctttcaaaattaaaagtcaaatacagtttttaacagtccta

SEQ ID NO: 305222 - DNA, 395 bp, Homo sapiens
cagctaaaagaggatattaggtgaaaacaactgacctagcatctgcatgtataattataaataaatatacatgcagctaaaagaggatattagctgcatgtatatttatttataattataaccctggtggactgcagccttcatctttattgggaatgagtttgttataaatcagaaatgggtccatgatgaccactgttttccaaacccagtctgttccctgctccctcgctggcaagccccaccacacaggagtgaggccaggggctaggagttctaagaacagaggctggggtgagggtggcacccaggcagctgcatctggtctgttttaatttaactgtatttaatttgctttcaaaattaaaagtcaaatacagtttttaacagtccta

SEQ ID NO: 305223 - DNA, 3573 bp, Homo sapiens
gcgggcgggcgcgcggaccccgcggctatgaagtggcccccgggggcccggagcccgacagtccccggggagggagccgcacgcggcccagggcagcggtctaggggcgccggggccggggcgtaggggccgttgcccgcgatggaccgcaccggagacgctccggactcgtcgccgcaggtgtccaccccccagggttcctgacccctgcccctggacagcgaccccttctcagactccagttgggccggactctccaaacctgcttccgcaatgggtaatgaggagccgtgggtgcagccagccttggagatgccgaagagacgggacatcctagcgatcgtcctcatcgtgctgccctggactctgctcatcactgtctggcaccagagcaccctcgcacccctgctcgcggtacataaggatgagggcagtgacccccgacgcgaaacgccgcccggcgccgaccccagggagtactgcacgtctgaccgcgacatcgtggaggtggtgcgcaccgagtacgtgtacacgcggcccccgccatggtccgacacgctgcccaccatccacgtggtgacgcccacctacagccgcccggtgcagaaggccgagctgacgcgcatggccaacacgctgctgcacgtgcccaacctccactggctggtggtggaggatgcgccgcgccggacgccgctgaccgcgcgcctgctgcgcgacaccggcctcaactacacgcacctgcacgtggagacgccccgcaactacaagctgcgcggagacgcccgcgacccacgcatcccgcggggcaccatgcagcgcaacctggccctgcgctggctgcgcgagaccttcccgcgcaactccagccagcctggcgtggtctacttcgccgacgacgacaacacctacagcctggagctcttcgaagagatgcgcagcaccaggagggtgtccgtgtggcccgtcgccttcgtgggtggcctgcggtacgaggccccacgggtgaacggggcagggaaggtggtcggctggaagacggtgtttgacccccaccggccatttgcaatagacatggctggatttgccgtcaacctgcggctcattctgcagcgaagccaggcctacttcaagctgcgaggtgtgaagggaggctaccaggaaagcagcctccttcgagaacttgtcaccctcaacgacctggagcccaaggcagccaactgcaccaagatcctggtgtggcacacacggacagagaagccagtgctggtgaatgagggcaagaagggcttcactgacccctcggtggagatctgagcctcaggatgcaggagcctcctcctcagaccctgttcttggccttccatcctctccccacggctgatggtccctccaaggccgactcctaaggaatcaccatcaccctcctttctattctgggggcttctgagagagcccagcctgatgccagaacaaaggacagagaatttaagcacagaaatcccagacctgttgttctctccatccagcgtgaccagggcccgagagacctgatggccagggtggggtgtccagcaccagccaagctggtgcccagcgcacctccccagagctccccgcactgacggggctgcaggagcaggtgcagtgggcgcccacactggccctgcagtgatgcagggcgggagggagataagaagaccccgcagtcaagtggagcatggccctccctggctccctgtccctgggctcagcacgaccacacaggacacccagccagggaattctgaagaccagagagcagcccacgggcatcacgagcgctctgctcctctcctgggcccctgctcttcccgagagctgcccccaaatcagacatacctctgtggctctcctctggttcacgtttacagagcataaggctgtcttggatcccaacaggcacccagccctgcatggggggagcctgggcctaataggcaccccctgtacctcaggctgtggcgggagcagagtccccccctccggcccctcttcctttaccccttctcctccagcagtggcaaaggggtaggctctagagccagcacaggtcactgcctgacctggactaagaaccccacggccccactgtccacacactgcctccccaccgcccacctcggctgctaggcccctcgcctggactggactggggagggaaagcgccttttcctgcagctcttcagagccacagacctcagggtggagtgagcccatggtgggcagtgggcaaggcggtgggtggtgggcaaggtgggacctcctgcagcctggaaagaggagggaggccaaggccattccctaactccctcctgcccctggtctgaggaggagggactctggagtagcagaggggctgggaaagagggggcaggggctgctgggacactgagcaggagggaggcctgagcacactgctttggaaattattctaaacacaaaaaagggaaagaaaatgttatttctccctaagtcaggagcatgcagagctagcccacctcatgtccagctgtccactttccatcctggagaaagaacagtgtgcctcaaactcctgccctccccaggcctctggggcccactggaaagggctctgaccccctggcccagccgggctctctagtggtgatccggctcattctcctgcaagttggaagcacaattttccccccaagtggaggaaaaggaaagggccccagcctactgaagaggtgtttattttttaactaacagcctcccaccccattaagactcaccaggagaggtctgagggccattcagaacccactcctgagtgggtgggtgggtgggactcagtccagagacctaacattcagaatatagcattggttgcctattttgagatggatttaatctcccacagtattcatgagaccatctgatggaatcagatccctgagccaccttgcaggacgttttccccaacctcttacaccctggatgtcactttggaaaccaagcccttggaagcaagtggggtggcatgggagagaagggaggaggtgggcacaggtggtgagcttatgtgtgggcactctactgcctcacagaagccagccaagtgccaaggtcagcttggctggtctgaggccaccttcttagccaaaaacctagggttcattttcaggactttgataatgaacaacaaaatggggacttctttgggcagatgctaggtcagttgttttcacctaatatcctcttttagctgcatgtatatttatttataattataaccctggtggactgcagccttcatctttattgggaatgagtttgttataaatcagaaatgggtccatgatgaccactgttttccaaacccagtctgttccctgctccctcgctggcaagccccaccacacaggagtgaggccaggggctaggagttctaagaacagaggctggggtgagggtggcacccaggcagctgcatctggtctgttttaatttaactgtatttaatttgctttcaaaattaaaagtcaaatacagtttttaacagtccta

SEQ ID NO: 305224 - DNA, 3951 bp, Homo sapiens
gcgggcgggcgcgcggaccccgcggctatgaagtggcccccgggggcccggagcccgacagtccccggggagggagccgcacgcggcccagggcagcggtctaggggcgccggggccggggcgtaggggccgttgcccgcgatggaccgcaccggagacgctccggactcgtcgccgcaggtgtccaccccccagggttcctgacccctgcccctggacagcgaccccttctcagactccagttgggccggactctccaaacctgcttccgcaatgggtaatgaggagccgtgggtgcagccagccttggagatgccgaagagacgggacatcctagcgatcgtcctcatcgtgctgccctggactctgctcatcactgtctggcaccagagcaccctcgcacccctgctcgcggtacataaggatgagggcagtgacccccgacgcgaaacgccgcccggcgccgaccccagggagtactgcacgtctgaccgcgacatcgtggaggtggtgcgcaccgagtacgtgtacacgcggcccccgccatggtccgacacgctgcccaccatccacgtggtgacgcccacctacagccgcccggtgcagaaggccgagctgacgcgcatggccaacacgctgctgcacgtgcccaacctccactggctggtggtggaggatgcgccgcgccggacgccgctgaccgcgcgcctgctgcgcgacaccggcctcaactacacgcacctgcacgtggagacgccccgcaactacaagctgcgcggagacgcccgcgacccacgcatcccgcggggcaccatgcagcgcaacctggccctgcgctggctgcgcgagaccttcccgcgcaactccagccagcctggcgtggtctacttcgccgacgacgacaacacctacagcctggagctcttcgaagagatgcgcagcaccaggagggtgtccgtgtggcccgtcgccttcgtgggtggcctgcggtacgaggccccacgggtgaacggggcagggaaggtggtcggctggaagacggtgtttgacccccaccggccatttgcaatagacatggctggatttgccgtcaacctgcggctcattctgcagcgaagccaggcctacttcaagctgcgaggtgtgaagggaggctaccaggaaagcagcctccttcgagaacttgtcaccctcaacgacctggagcccaaggcagccaactgcaccaagatcctggtgtggcacacacggacagagaagccagtgctggtgaatgagggcaagaagggcttcactgacccctcggtggagatctgagcctcaggatgcaggagcctcctcctcagaccctgttcttggccttccatcctctccccacggctgatggtccctccaaggccgactcctaaggaatcaccatcaccctcctttctattctgggggcttctgagagagcccagcctgatgccagaacaaaggacagagaatttaagcacagaaatcccagacctgttgttctctccatccagcgtgaccagggcccgagagacctgatggccagggtggggtgtccagcaccagccaagctggtgcccagcgcacctccccagagctccccgcactgacggggctgcaggagcaggtgcagtgggcgcccacactggccctgcagtgatgcagggcgggagggagataagaagaccccgcagtcaagtggagcatggccctccctggctccctgtccctgggctcagcacgaccacacaggacacccagccagggaattctgaagaccagagagcagcccacgggcatcacgagcgctctgctcctctcctgggcccctgctcttcccgagagctgcccccaaatcagacatacctctgtggctctcctctggttcacgtttacagagcataaggctgtcttggatcccaacaggcacccagccctgcatggggggagcctgggcctaataggcaccccctgtacctcaggctgtggcgggagcagagtccccccctccggcccctcttcctttaccccttctcctccagcagtggcaaaggggtaggctctagagccagcacaggtcactgcctgacctggactaagaaccccacggccccactgtccacacactgcctccccaccgcccacctcggctgctaggcccctcgcctggactggactggggagggaaagcgccttttcctgcagctcttcagagccacagacctcagggtggagtgagcccatggtgggcagtgggcaaggcggtgggtggtgggcaaggtgggacctcctgcagcctggaaagaggagggaggccaaggccattccctaactccctcctgcccctggtctgaggaggagggactctggagtagcagaggggctgggaaagagggggcaggggctgctgggacactgagcaggagggaggcctgagcacactgctttggaaattattctaaacacaaaaaagggaaagaaaatgttatttctccctaagtcaggagcatgcagagctagcccacctcatgtccagctgtccactttccatcctggagaaagaacagtgtgcctcaaactcctgccctccccaggcctctggggcccactggaaagggctctgaccccctggcccagccgggctctctagtggtgatccggctcattctcctgcaagttggaagcacaattttccccccaagtggaggaaaaggaaagggccccagcctactgaagaggtgtttattttttaactaacagcctcccaccccattaagactcaccaggagaggtctgagggccattcagaacccactcctgagtgggtgggtgggtgggactcagtccagagacctaacattcagaatatagcattggttgcctattttgagatggatttaatctcccacagtattcatgagaccatctgatggaatcagatccctgagccaccttgcaggacgttttccccaacctcttacaccctggatgtcactttggaaaccaagcccttggaagcaagtggggtggcatgggagagaagggaggaggtgggcacaggtggtgagcttatgtgtgggcactctactgcctcacagaagccagccaagtgccaaggtcagcttggctggtctgaggccaccttcttagccaaaaacctagggttcattttcaggactttgataatgaacaacaaaatggggacttctttgggcagatgctaggtcagttgttttcacctaatatcctcttttagctgcatgtatatttatttataattataaccctggtggactgcagccttcatctttattgggaatgagtttgttataaatcagaaatgggtccatgatgaccactgttttccaaacccagtctgttccctgctccctcgctggcaagccccaccacacaggagtgaggccaggggctaggagttctaagaacagaggctggggtgagggtggcacccaggcagctgcatctggtctgttttaatttaactgtatttaatttgctttcaaaattaaaagtcaaatacagtttttaacagtcctaaaaaaaaaaaaaaaaaaaaaaaaaaaaaaaaaaaaaaaaaaaaaaaaaaaaggggggggggcccaaaaattcccccggggggggcccccattcggcgaccccagtttgcttcgaaaacaagggggtggccccataagggtgagagcgcgcgtccatataataaacaaccagcagcaacgcgggcccccgatcgataaaaacaaaggcgtcgtgtgaagcggggacaaaacatgcggaccagaatgggacgagcactcagggagagaagaggcacccctaaaaatccgtggggggcggaaccactatagtgctggcacgaactcccctcaagaagattttaacgctccaggaggcaaaataacaactcacacgcgttcg

SEQ ID NO: 305225 - DNA, 10645 bp, Homo sapiens
ggggaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagttttacctcacaaaaactactacaagcaccaagctccctgatggaaaggagcatcgtgcatcaagtcaccagggtggtccattcaagctgcagatttgtttgtcatccttgtacagcaatctcctcctccactgccactacagggaagtgcatcacatgtcagcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagagtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggctttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgttcacagtaatccttaccaagataacatactgtcaacccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 305226 - DNA, 1761 bp, Homo sapiens
ggggaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagagcatcgtgcatcaagtcaccagggtggtccattcaagctgcagatttgtttgtcatccttgtacagcaatctcctcctccactgccactacagggaagtgcatcacatgtcaggtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggtttttttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggactttc

SEQ ID NO: 305227 - DNA, 1646 bp, Homo sapiens
ggggaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggtttttttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggactttc

SEQ ID NO: 305228 - DNA, 1320 bp, Homo sapiens
tcctcacgattgacggctcaacgtaggcagaaaaatagtatcattcatgttgtactcttttatattcattcagtttttttcttaaacctacattatagttctttctggttctagttattttataaatatgatacagctatagcaagttatgacctaacttgttcacagtcactatttatgtaaagaaatgattcattcatttattcattgtgaattttttttaaaactactgcatggtgctgtgggaatggaagtgaataagagctaccggaaggcagttattttcttcctggtcaggcaggggaaagaagaaactctctgaaataatgaatacgaatagaatggggttctaacagtgttctaacagtgaaggaattcagaagagtgacgctgagtaggagtgatcaggaaagactttgaggaggagggatcacttgagttgagctctgctgactagattgcatttctgtgggaagagatggatggagcatgaggaaggccatgtgtgtgtctgggacataacaagccaatgcacgcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttatctgatgcacaaaggaaaataataatacaaaacccataacctattcattgtattgttgcggtagatcgagctacatgctgcacagcaaaagaccttctttgcacttctttcaagcagaattattgctgtatattcactctgaactgagagatcattgcaaaaaaaaaaaagaagaagaagaagagaagaaaagaaaaaagaaataggttaagcaaattttgtggtggtgcttatgtgtgcacagacatgcatgaggcctccgcatcttccaaacttggaaagcatattttaacagcacaaatatatctacatgtttgatctacatcaga

SEQ ID NO: 305229 - DNA, 700 bp, Homo sapiens
tcctcacgattgacggctcaacgtaggcagaaaaatagtatcattcatgttgtactcttttatattcattcagtttttttcttaaacctacattatagttctttctggttctagttattttataaatatgatacagctatagcaagttatgacctaacttgttcacagtcactatttatgtaaagaaatgattcattcatttattcattgtgaattttttttaaaactactgcatggtgctgtgggaatggaagtgaataagagctaccggaaggcagttattttcttcctggtcaggcaggggaaagaagaaactctctgaaataatgaatacgaatagaatggggttctaacagtgttctaacagtgaaggaattcagaagagtgacgctgagtaggagtgatcaggaaagactttgaggaggagggatcacttgagttgagctctgctgactagattgcatttctgtgggaagagatggatggagcatgaggaaggccatgtgtgtgtctgggacataacaagccaatgcacggtatgtaactgaccaggacattttgactgaagcctaggtgctggtggacatctgaatttctggattcgagcagacagtagagagtatgggaataaaactgccgagaggtcaagtctgaagataaatttggaggagtccttggcataaaagtgatctttgaaatt

SEQ ID NO: 305230 - DNA, 10821 bp, Homo sapiens
tcctcacgattgacggctcaacgtaggcagaaaaatagtatcattcatgttgtactcttttatattcattcagtttttttcttaaacctacattatagttctttctggttctagttattttataaatatgatacagctatagcaagttatgacctaacttgttcacagtcactatttatgtaaagaaatgattcattcatttattcattgtgaattttttttaaaactactgcatggtgctgtgggaatggaagtgaataagagctaccggaaggcagttattttcttcctggtcaggcaggggaaagaagaaactctctgaaataatgaatacgaatagaatggggttctaacagtgttctaacagtgaaggaattcagaagagtgacgctgagtaggagtgatcaggaaagactttgaggaggagggatcacttgagttgagctctgctgactagattgcatttctgtgggaagagatggatggagcatgaggaaggccatgtgtgtgtctgggacataacaagccaatgcacgcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagagtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggctttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgttcacagtaatccttaccaagataacatactgtcaacccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 305231 - DNA, 10481 bp, Homo sapiens
ggggaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacacatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagagtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggctttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgttcacagtaatccttaccaagataacatactgtcaacccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 305232 - DNA, 10596 bp, Homo sapiens
ggggaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagagcatcgtgcatcaagtcaccagggtggtccattcaagctgcagatttgtttgtcatccttgtacagcaatctcctcctccactgccactacagggaagtgcatcacatgtcagcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagagtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggctttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgttcacagtaatccttaccaagataacatactgtcaacccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 305233 - DNA, 10195 bp, Homo sapiens
ctgcctcagcctctcaagtagctgggactacagccgtgtgccagctaatgttacaccaggctaaatttgttttttattttttatttttggtagagacggggtttcaccatgttagccaggatggtcttaatctcctgacctcgtgatctgcctgcctcggcctcccaaagtgttggctagtgttttctctgcttcagtgcttggggtatgattgggttatgggagttcacaccgagtccagggcctagtcttaatcttgccaaagatgttctttccccggtgctcatgttctgatgtcctttccctccttccctttctcctccctttccttttccctttgtcactgccctcttccctttcccagcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagagtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggctttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgttcacagtaatccttaccaagataacatactgtcaacccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 305234 - DNA, 10767 bp, Homo sapiens
tcctcacgattgacggctcaacgtaggcagaaaaatagtatcattcatgttgtactcttttatattcattcagtttttttcttaaacctacattatagttctttctggttctagttattttataaatatgatacagctatagcaagttatgacctaacttgttcacagtcactatttatgtaaagaaatgattcattcatttattcattgtgaattttttttaaaactactgcatggtgctgtgggaatggaagtgaataagagctaccggaaggcagttattttcttcctggtcaggcaggggaaagaagaaactctctgaaataatgaatacgaatagaatggggttctaacagtgttctaacagtgaaggaattcagaagagtgacgctgagtaggagtgatcaggaaagactttgaggaggagggatcacttgagttgagctctgctgactagattgcatttctgtgggaagagatggatggagcatgaggaaggccatgtgtgtgtctgggacataacaagccaatgcacgcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagagtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggctttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgttcacagtaatccttaccaagataacatactgtcaacccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 305235 - DNA, 8856 bp, Homo sapiens
tcctcacgattgacggctcaacgtaggcagaaaaatagtatcattcatgttgtactcttttatattcattcagtttttttcttaaacctacattatagttctttctggttctagttattttataaatatgatacagctatagcaagttatgacctaacttgttcacagtcactatttatgtaaagaaatgattcattcatttattcattgtgaattttttttaaaactactgcatggtgctgtgggaatggaagtgaataagagctaccggaaggcagttattttcttcctggtcaggcaggggaaagaagaaactctctgaaataatgaatacgaatagaatggggttctaacagtgttctaacagtgaaggaattcagaagagtgacgctgagtaggagtgatcaggaaagactttgaggaggagggatcacttgagttgagctctgctgactagattgcatttctgtgggaagagatggatggagcatgaggaaggccatgtgtgtgtctgggacataacaagccaatgcacgcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagagtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggctttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtagataatgacaaagatcatgtgcatctgcttagaatatcaccatacatgttctcaaatatctttagatatatgat

SEQ ID NO: 305236 - DNA, 885 bp, Homo sapiens
gaacgaataagtggaggctcagtgcacatgtttgctcgtgcttctttccggataccgctattcaattcgtaatcagggccatgactggggtatgtcttaaaattagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 305237 - DNA, 2437 bp, Homo sapiens
ggggaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagagcatcgtgcatcaagtcaccagggtggtccattcaagctgcagatttgtttgtcatccttgtacagcaatctcctcctccactgccactacagggaagtgcatcacatgtcaggtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggtttttttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggactttctgaaacagattaccttttttcttctcctcatgatggctccctgagttgcttccaattgttgaaattccataattacccacaaatatggatgtgcccttctaagggtcttgccatgtcaaccagcccagctgaaagctaatagccagtgttagcggtttaaggaactgagcttcagaattgagagcccccagcaaaggaagttctgtttttattctccatttctactctcctcaaggagaaattaggtgtttattgttttgttttgttttttaaattcccagatcattctggcattggtcctggattcgctgcaaatgtaatttttagcaacatctattactcctgaaatattttggctcttcgtggcctgtatgattcagtagactctgaggttttccaagtacattaaggacttaaatacagaatgtcttaaaattttagggctattgatcaagagaaagcttctcgaggaataaagttctgttaggttttagccctattctgctttcaaaattcttaactggatgccgtctattttgttttctttctgtgtttataactaatttgctacttgggtttattgttttcttacttagaaactacttttttttttgttttgtaaatgcacagcacttaaaaatataaaacagttccaaacagttccaaaaaaaaaatt

SEQ ID NO: 305238 - DNA, 2197 bp, Homo sapiens
gtcaaggagatacagcctggcagggacttttgcttggtgatggagtagctaagaatgtttctctctaacaggtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggtttttttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggactttctgaaacagattaccttttttcttctcctcatgatggctccctgagttgcttccaattgttgaaattccataattacccacaaatatggatgtgcccttctaagggtcttgccatgtcaaccagcccagctgaaagctaatagccagtgttagcggtttaaggaactgagcttcagaattgagagcccccagcaaaggaagttctgtttttattctccatttctactctcctcaaggagaaattaggtgtttattgttttgttttgttttttaaattcccagatcattctggcattggtcctggattcgctgcaaatgtaatttttagcaacatctattactcctgaaatattttggctcttcgtggcctgtatgattcagtagactctgaggttttccaagtacattaaggacttaaatacagaatgtcttaaaattttagggctattgatcaagagaaagcttctcgaggaataaagttctgttaggttttagccctattctgctttcaaaattcttaactggatgccgtctattttgttttctttctgtgtttataactaatttgctacttgggtttattgttttcttacttagaaactacttttttttttgttttgtaaatgcacagcacttaaaaatataaaacagttccaaacagttccaaaaaaaaaatt

SEQ ID NO: 305239 - DNA, 4607 bp, Homo sapiens
tcctcacgattgacggctcaacgtaggcagaaaaatagtatcattcatgttgtactcttttatattcattcagtttttttcttaaacctacattatagttctttctggttctagttattttataaatatgatacagctatagcaagttatgacctaacttgttcacagtcactatttatgtaaagaaatgattcattcatttattcattgtgaattttttttaaaactactgcatggtgctgtgggaatggaagtgaataagagctaccggaaggcagttattttcttcctggtcaggcaggggaaagaagaaactctctgaaataatgaatacgaatagaatggggttctaacagtgttctaacagtgaaggaattcagaagagtgacgctgagtaggagtgatcaggaaagactttgaggaggagggatcacttgagttgagctctgctgactagattgcatttctgtgggaagagatggatggagcatgaggaaggccatgtgtgtgtctgggacataacaagccaatgcacgcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagagtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggctggcaaaacgaataaattaccacacctcgatgtggttatgaaaagttgtttttgttcctacgttcctagtttcttacggattcacggcatgggaagtaaaacattgactatgtgccaataatggaggtcagtattttacctgactctctgtctgcttatttagtaagtcaacccccttt

SEQ ID NO: 305240 - DNA, 1275 bp, Homo sapiens
tcctcacgattgacggctcaacgtaggcagaaaaatagtatcattcatgttgtactcttttatattcattcagtttttttcttaaacctacattatagttctttctggttctagttattttataaatatgatacagctatagcaagttatgacctaacttgttcacagtcactatttatgtaaagaaatgattcattcatttattcattgtgaattttttttaaaactactgcatggtgctgtgggaatggaagtgaataagagctaccggaaggcagttattttcttcctggtcaggcaggggaaagaagaaactctctgaaataatgaatacgaatagaatggggttctaacagtgttctaacagtgaaggaattcagaagagtgacgctgagtaggagtgatcaggaaagactttgaggaggagggatcacttgagttgagctctgctgactagattgcatttctgtgggaagagatggatggagcatgaggaaggccatgtgtgtgtctgggacataacaagccaatgcacgcatactggagcatagtgaaagagtctattttgaagcttcaaacttagtgctgctgcagaccaggaacaagagagaaagagtggatttcagcctgcacggatggtcttgaaacacaaatggtttttggtaagtcatccaaaagacttgacatcttttagctttaaatgtcatcgggcatcacttcactggtgtaccagaacttcttcttcaagcgtattgctatttctctacatcctaaataacaggacatttgaaaaaatgttgtcctagtgacagagcactgagagagcaaccgcatttactttatgtgtttgtttctgaaacttgcagaatagtatgatctgaatagaatgtatttgtggttagaaaaaagaacaaaagcaaaaacaaagcaaacccaaacaactaaacacacaaacagcaaataaactacatctaccagatactccattttagctgaaaacataagggattaatcgcacgagaggaagtagattcaatttaatggcaagttttttgcgtcttgtgatcaaatacagtcatgtgccacataatgaagtttcagtcaacgacagatcacacgtattacagtggtcccataagattataatactgggctgggtgtggtgctcacgcctgtaatcccagcactttgggaggccgaggcgcgcggatcacgaggtcaggagattgagatcatcctggtaacgcggtgaaaccctgtctctactaagaatac

SEQ ID NO: 305241 - DNA, 583 bp, Homo sapiens
agagctgtgaactaataactagtagcagtagataatgtactcagatgccacatgaaatgcaaaagattctatgctttattccataaagcatggctataggacattgtctactatgtaactaatatttaaatatttatagatttttaaaagatttcttcaaccttcttttctcaccctgtttctagatctgatgcacaaaggaaaataataatacaaaacccataacctattcattgtattgttgcggtagatcgagctacatgctgcacagcaaaagaccttctttgcacttctttcaagcagaattattgctgtatattcactctgaactgagaggtgaggattgaactgtgtagtgcctcagaaaatatcaagagttttaaaacattagttttgagagattgaaatacatagaaacttggaatgtttgaatgtcagcccagacattggcaggcttccatgcagatttcattgtgagtaaaatgtgtactcagtggctgggttcaagcccttcatagtttataagcaaatgtctctgcttcttctagatcattgcaaaaaaaaaaaagaagaagaagaagag

SEQ ID NO: 305242 - DNA, 2356 bp, Homo sapiens
tcagcagccgccagacttcctgccgaagtccgagccccctcccggggctggaggggggcaagcgggttccgaggtgcaaagcctggtgccccgagccctgcggagctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagctttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgag

SEQ ID NO: 305243 - DNA, 703 bp, Homo sapiens
ctccggacgcgtgtaaatacaactatcaactccgcagatccacttcatccaagcccagcttcgcagacctctggcgcccggcgggttcccagttcccccgcttcttccgaggagacagcggaggcgaggccaccgggctgtcaggctgaagctccgtggccgccgggtcctgcacgcagagaagaccccagcgccggcgcggctcagggctgggcccacgggactccggacgcgccgcgaaagcgttgcgctcccggaggcgtccgcagctgctggctgctcatttgccggtgaccggaggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcaggtgaggtggctgggctatggggaacgggaggacagggaccgtgctgcagggggagggg

SEQ ID NO: 305244 - DNA, 2797 bp, Homo sapiens
tcagcagccgccagacttcctgccgaagtccgagccccctcccggggctggaggggggcaagcgggttccgaggtgcaaagcctggtgccccgagccctgcggagctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagctttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgagagactggctggtgtgcgcctgtctttggcggttggtggggggtgtcttcccacacccccatccttcttcacccaggctcagctgggcattaactaggacgcttggcatgccagcccgttcgcctctggctgtctggctcacctccctgttcccaaccatgccctgcccttagtgcttggagggagtccagctcctgccccctacttcccaggatttggggtacatccaggaagctggcttttctccatacagaggattaggacagaatgctttagaaagaatgctaaggtatgactcaaacttcccaccatagcatccctagggcctgccgaaagtaacacttttttggagtctcctattttatcttaaaactttatgcaaattttgagcttccttgttatactatatttacatttacctttaacattaaagtgaggcttt

SEQ ID NO: 305245 - DNA, 2654 bp, Homo sapiens
ctccggacgcgtgtaaatacaactatcaactccgcagatccacttcatccaagcccagcttcgcagacctctggcgcccggcgggttcccagttcccccgcttcttccgaggagacagcggaggcgaggccaccgggctgtcaggctgaagctccgtggccgccgggtcctgcacgcagagaagaccccagcgccggcgcggctcagggctgggcccacgggactccggacgcgccgcgaaagcgttgcgctcccggaggcgtccgcagctgctggctgctcatttgccggtgaccggagagctgcgcgtttgccagagttccagcggacctcctggagcgcttgaacccaaagccccgtttcacagatgagaataccgagtccccctggaagaagtgactggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagctttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgag

SEQ ID NO: 305246 - DNA, 2552 bp, Homo sapiens
ctccggacgcgtgtaaatacaactatcaactccgcagatccacttcatccaagcccagcttcgcagacctctggcgcccggcgggttcccagttcccccgcttcttccgaggagacagcggaggcgaggccaccgggctgtcaggctgaagctccgtggccgccgggtcctgcacgcagagaagaccccagcgccggcgcggctcagggctgggcccacgggactccggacgcgccgcgaaagcgttgcgctcccggaggcgtccgcagctgctggctgctcatttgccggtgaccggaggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagctttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgag

SEQ ID NO: 305247 - DNA, 2317 bp, Homo sapiens
tcagcagccgccagacttcctgccgaagtccgagccccctcccggggctggaggggggcaagcgggttccgaggtgcaaagcctggtgccccgagccctgcggagctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagatcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagctttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgag

SEQ ID NO: 305248 - DNA, 2358 bp, Homo sapiens
ggcaactggaagatggggtcgtagggtagccttgaacttgcccttcttcctgccagcttctaggggtctttcctggcgcgagagtccggacatgggcccgcggtgcttcagagcgcgctctgccccttgctgtcctctggggacctgggcagatgcggactttctccccagcagcccggccctgagcgccctggcctgggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagctttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgag

SEQ ID NO: 305249 - DNA, 2597 bp, Homo sapiens
ctccggacgcgtgtaaatacaactatcaactccgcagatccacttcatccaagcccagcttcgcagacctctggcgcccggcgggttcccagttcccccgcttcttccgaggagacagcggaggcgaggccaccgggctgtcaggctgaagctccgtggccgccgggtcctgcacgcagagaagaccccagcgccggcgcggctcagggctgggcccacgggactccggacgcgccgcgaaagcgttgcgctcccggaggcgtccgcagctgctggctgctcatttgccggtgaccggaggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgttcctggtgtcatgtgctgagccctcccttccccctcctcagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagctttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgag

SEQ ID NO: 305250 - DNA, 1888 bp, Homo sapiens
cccagacttggacgaggacgtcccgtgctgagtcttgcgggcccagctgctgttgccacgcacgctgcaaggccgccagcccggggttagccggccggcctcgccttacccacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagctttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgag

SEQ ID NO: 305251 - DNA, 2401 bp, Homo sapiens
tcagcagccgccagacttcctgccgaagtccgagccccctcccggggctggaggggggcaagcgggttccgaggtgcaaagcctggtgccccgagccctgcggagctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgttcctggtgtcatgtgctgagccctcccttccccctcctcagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagctttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgag

SEQ ID NO: 305252 - DNA, 2129 bp, Homo sapiens
tcagcagccgccagacttcctgccgaagtccgagccccctcccggggctggaggggggcaagcgggttccgaggtgcaaagcctggtgccccgagccctgcggagctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacggaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagctttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgag

SEQ ID NO: 305253 - DNA, 2058 bp, Homo sapiens
aggagatctgagtaggaggcacctcagcaatggcactcgatgccatgtggtcccaaaaagagggacataaaagaatcaagcactgtacttagcccctataccatcctcaaacagctgtatgatgtagattgggtattaaccccattaataacaaaagtacagggaacaaagtgactttccaaaggtcatgccattcaaaggagggtgaatcttaggttggacgcaggctgtctgactctggagtctgaggtgttaatgctgcctcctccatgggaacagcccaagtgaaaaacagctgatccactcttcatttacttggcatctgtgctaagctggtccctgagccaagctctgagcaacagaaacagaagctctgcattaggagcttgtgagcatgtcaatgccgggtaaaggagtgctggaaaccgctgggatggccgccgagcactaggccgttgaaggtgggctctgtgtgactggttcctctacactctggcctggctgcctgcaggaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagctttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgag

SEQ ID NO: 305254 - DNA, 1264 bp, Homo sapiens
ctgagaaggaggcactcagtaagaattgccattatttgcccaaagtcacacagtgagtaatgcagagtgggatgtgaaccgagtcagagcccgcgtgtcctgggccttccaagccttctgtccaccaggctgtgcatcccagttccttgaactgtgtctgagagcctcctctcgccaccctgaacgggatcccattggttaacatctccaaaggtcagaggggtgagcccagaaggccccatttcgggagcagcctgaccagcccagactcctacagtgctgtgccttcctcatacctacctagtgagtgccatatggtgtgggcacccaccaggccctgccacttgttatacctgagaagtctcatctcagccactttgcagaattgctgaacattaagtgagatactggtggaacaatgactacacataataagtactagctgtatttattctggctcaggacctggagaaaaatggccgcctttcttcctccctgtgggaggctaagggcagatgactacctacttgactctgtttctctctccttgccctaaaggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagctttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgag

SEQ ID NO: 305255 - DNA, 1887 bp, Homo sapiens
tcagcagccgccagacttcctgccgaagtccgagccccctcccggggctggaggggggcaagcgggttccgaggtgcaaagcctggtgccccgagccctgcggagctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgtgagtctgttgggctgaaatgccttcctgagctttgcaaccgtgatcagagaaccccagggaagggttgggagggccccaggcatcccctaatgcacctctctctgagaccctctgatggcagggagctcacttccttaaaggcagcctatcctgctgtaattgactccccctgttggagtcttcccttagaggaagctgaaatacctggcttgatgacactttggttctatgtctgctgtttgaaacggccctcagatgatttcccccctccgcctccaggaagaaagaatgttactgccttaataaaaaatgaaaagagaatgatgctcaaaatctttccaaataaaatgttcccaat

SEQ ID NO: 305256 - DNA, 1055 bp, Homo sapiens
  misc_feature (1055)..(1055): n is a, c, g, or t
tcagcagccgccagacttcctgccgaagtccgagccccctcccggggctggaggggggcaagcgggttccgaggtgcaaagcctggtgccccgagccctgcggagctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacaggaagatcaagctgagtgggatggccctgaaccacaaggttaacaagggtgaacatcttttaaaacccaatgtgaaccaacaatatgtccatagggttcaagcaaagaaggccccaatgcttgaagaactgatatggaatgccttttaatgttagcccacggagaagtatacgggggcaacatcagagaaaaactatacaggaaaaggtatggtaccaataacaaagaagcatatgttacacccn

SEQ ID NO: 305257 - DNA, 1457 bp, Homo sapiens
ctccggacgcgtgtaaatacaactatcaactccgcagatccacttcatccaagcccagcttcgcagacctctggcgcccggcgggttcccagttcccccgcttcttccgaggagacagcggaggcgaggccaccgggctgtcaggctgaagctccgtggccgccgggtcctgcacgcagagaagaccccagcgccggcgcggctcagggctgggcccacgggactccggacgcgccgcgaaagcgttgcgctcccggaggcgtccgcagctgctggctgctcatttgccggtgaccggagagctgcgcgtttgccagagttccagcggacctcctggagcgcttgaacccaaagccccgtttcacagatgagaataccgagtccccctggaagaagtgactggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgtgagtctgttgggctgaaatgccttcctgagctttgcaaccgtgatcagagaaccccagggaagggttgggagggccccaggcatcccctaatgcacctctctctgagaccctctgatggcagggagctcacttccttaaaggcagcctatcctgctgtaattgactccccctgttggagtcttcccttagaggaagctgaaatacctggcttgatgacactttggttctatgtctgctgtttgaaacggccctcagatgatttcccccctccgcctccaggaagaaagaatgttactgccttaataaaaaatgaaaagagaatgatgctcaaaatctttccaaataaaatgttcccaat

SEQ ID NO: 305258 - DNA, 1254 bp, Homo sapiens
ctccggacgcgtgtaaatacaactatcaactccgcagatccacttcatccaagcccagcttcgcagacctctggcgcccggcgggttcccagttcccccgcttcttccgaggagacagcggaggcgaggccaccgggctgtcaggctgaagctccgtggccgccgggtcctgcacgcagagaagaccccagcgccggcgcggctcagggctgggcccacgggactccggacgcgccgcgaaagcgttgcgctcccggaggcgtccgcagctgctggctgctcatttgccggtgaccggagagctgcgcgtttgccagagttccagcggacctcctggagcgcttgaacccaaagccccgtttcacagatgagaataccgagtccccctggaagaagtgactggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacggtgagtgtcacaggcctggcctggcagcagagttcccccgagtggggtgagggcagagtgagtggggtgagggcagtatgagtgggctgggggaggggcctgtggacgcagatcactagatcaagtgagtgtgtgagaaactgtgcaggtggctgcaaagagcaggtgtgaggctgtgtgtgtgtggatgaggctgtgtgtcggggtgtatgttaatgtgtgtgtttgtgtgtacagagcccatgaatgtccatggagctctgttctaggtcctggactacagcacaatcaggactgaccgagtcatcctccctgctggaggttacattttgggggtgaggggcacagataacccaataaacaagtaaactaat

SEQ ID NO: 305259 - DNA, 156 bp, Homo sapiens
gcggccgcctactactactactgctcgaattcaagcttctaacgatgtacggggacatggtttcttccctgccagaaatgaaggttcagttatgaggcaaccctctagtaaggcattgtaaaagttactggatttggtttaataaaagttgaaata

SEQ ID NO: 305260 - DNA, 1717 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttcctttt

SEQ ID NO: 305261 - DNA, 619 bp, Homo sapiens
gtagcgggaaccatatacggctaggtacgaggctgggtggctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaata

SEQ ID NO: 305262 - DNA, 729 bp, Homo sapiens
gtagcgggaaccatatacggctaggtacgaggctgggtggctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaatacaccaaacaacaaaaaactccggggcatcaatgccgggcggcggcccacagcgcgggtcttgaattgggccatgggcatagcctgttcctgaccagctttctgtccacgt

SEQ ID NO: 305263 - DNA, 613 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccactctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaa

SEQ ID NO: 305264 - DNA, 750 bp, Homo sapiens
gtcagtctattattgtccttgtggagacctgagcaagccaggcctggcttgctcaggtctcagatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggtacctgaaaggaagggcaggtgcatgaagggtgcagaacagtaggtgggctttcaagccctacccgggtttgattcacagctctgccacttgcccattagctttgagggtgtggactagttactagacctcatgttttaattcatttagcaaatatatattatgtgcagacctgctagtactgggtaacaatcattagttaagatttggtctcaggccaggcacggtggctcacgcctgtaatcccagcactttgggaggccgaggctggcagatcacctgaggtcaggagtttgagaccagcctgaccaacatggagaaaccccgtgtctactaaaaatacaaaaatagccgagtgtggtggcgcatgcctataatgccagctatttgggaggctgaggcaggagaatcgcttgaacccgggaggtggaggttgcagtgagctgagattgcaccattgcggtccagcctgggcaacaagagactccatc

SEQ ID NO: 305265 - DNA, 3704 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 305266 - DNA, 2911 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaata

SEQ ID NO: 305267 - DNA, 2968 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaaacaaaaaaaaaaaaccccggggtcttttgggggcggacagggatgaaaggcctgt

SEQ ID NO: 305268 - DNA, 3795 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattggtgaggggcctggagagtaacgggagagagggaacagtggcgccggggggggccaggggccccggtttctaacctctccgtctctccctagcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 305269 - DNA, 2977 bp, Homo sapiens
  misc_feature (2922)..(2922): n is a, c, g, or t
  misc_feature (2944)..(2944): n is a, c, g, or t
  misc_feature (2960)..(2960): n is a, c, g, or t
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaatataagggtgggnttttgggaaaaaaaaagcatantacattgtaatattancccttggggggggcgcc

SEQ ID NO: 305270 - DNA, 4319 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgaggtttgaaatgggaagtggggggcgcgaccgctgttgaggaagagaaggcattgatcttggtgtggctacaagtacccacctggcgtgggtagctcacgcctgcaatcccagcactctgggaggtcgaggcaggagtggatggccaacacagggagaccctatttgaaaacaaaaaacaaaaaaaagacacaatattgttttctgtctagtgtgccctaagtggaatttatgtcctttgggagactgtagttgacttgccctgggggtatggacaagttttccatttggaagtttatttcatgttacttcatttatgcttatccctaccctcttctgtttggttcttgggtgttctgttactgtcctgtgttaacactgcattacaataccattaaatttggttacaaggattttgaccttgtctttgtccctagtgcttcatacagtgctttggcatgttgttctgcacttattatgttgagtgagatttggaggaaggatgcaatccttgagcttcagggtttgtgagttcaagggttggggaacatgtcttcctcagtccttaagattgcccggatcctttctctaaccttatttcccttctcatttttgcagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 305271 - DNA, 3526 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgaggtttgaaatgggaagtggggggcgcgaccgctgttgaggaagagaaggcattgatcttggtgtggctacaagtacccacctggcgtgggtagctcacgcctgcaatcccagcactctgggaggtcgaggcaggagtggatggccaacacagggagaccctatttgaaaacaaaaaacaaaaaaaagacacaatattgttttctgtctagtgtgccctaagtggaatttatgtcctttgggagactgtagttgacttgccctgggggtatggacaagttttccatttggaagtttatttcatgttacttcatttatgcttatccctaccctcttctgtttggttcttgggtgttctgttactgtcctgtgttaacactgcattacaataccattaaatttggttacaaggattttgaccttgtctttgtccctagtgcttcatacagtgctttggcatgttgttctgcacttattatgttgagtgagatttggaggaaggatgcaatccttgagcttcagggtttgtgagttcaagggttggggaacatgtcttcctcagtccttaagattgcccggatcctttctctaaccttatttcccttctcatttttgcagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaata

SEQ ID NO: 305272 - DNA, 4481 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgagtggggacctggatgtgggggagagggacgtgggtgaaagggacgtgggttccgaagacaggaagcgctattcttagaaaccacggcagtctcatgacttcagagacgtgctcgtgggttccgaagtattgtaacttcgcttcattctggcctttcaggtgcggagctctggactgggattaagaaggggcccccacgcaaactcaaattccctgagcctcaagaggtggtggaagagttgaagaagtacctgtcgtagggagatttgggtagaagccctcatgctgaggtttgaaatgggaagtggggggcgcgaccgctgttgaggaagagaaggcattgatcttggtgtggctacaagtacccacctggcgtgggtagctcacgcctgcaatcccagcactctgggaggtcgaggcaggagtggatggccaacacagggagaccctatttgaaaacaaaaaacaaaaaaaagacacaatattgttttctgtctagtgtgccctaagtggaatttatgtcctttgggagactgtagttgacttgccctgggggtatggacaagttttccatttggaagtttatttcatgttacttcatttatgcttatccctaccctcttctgtttggttcttgggtgttctgttactgtcctgtgttaacactgcattacaataccattaaatttggttacaaggattttgaccttgtctttgtccctagtgcttcatacagtgctttggcatgttgttctgcacttattatgttgagtgagatttggaggaaggatgcaatccttgagcttcagggtttgtgagttcaagggttggggaacatgtcttcctcagtccttaagattgcccggatcctttctctaaccttatttcccttctcatttttgcagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 305273 - DNA, 2891 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttggctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaata

SEQ ID NO: 305274 - DNA, 4572 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattggtgaggggcctggagagtaacgggagagagggaacagtggcgccggggggggccaggggccccggtttctaacctctccgtctctccctagcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgagtggggacctggatgtgggggagagggacgtgggtgaaagggacgtgggttccgaagacaggaagcgctattcttagaaaccacggcagtctcatgacttcagagacgtgctcgtgggttccgaagtattgtaacttcgcttcattctggcctttcaggtgcggagctctggactgggattaagaaggggcccccacgcaaactcaaattccctgagcctcaagaggtggtggaagagttgaagaagtacctgtcgtagggagatttgggtagaagccctcatgctgaggtttgaaatgggaagtggggggcgcgaccgctgttgaggaagagaaggcattgatcttggtgtggctacaagtacccacctggcgtgggtagctcacgcctgcaatcccagcactctgggaggtcgaggcaggagtggatggccaacacagggagaccctatttgaaaacaaaaaacaaaaaaaagacacaatattgttttctgtctagtgtgccctaagtggaatttatgtcctttgggagactgtagttgacttgccctgggggtatggacaagttttccatttggaagtttatttcatgttacttcatttatgcttatccctaccctcttctgtttggttcttgggtgttctgttactgtcctgtgttaacactgcattacaataccattaaatttggttacaaggattttgaccttgtctttgtccctagtgcttcatacagtgctttggcatgttgttctgcacttattatgttgagtgagatttggaggaaggatgcaatccttgagcttcagggtttgtgagttcaagggttggggaacatgtcttcctcagtccttaagattgcccggatcctttctctaaccttatttcccttctcatttttgcagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 305275 - DNA, 3073 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgagtggggacctggatgtgggggagagggacgtgggtgaaagggacgtgggttccgaagacaggaagcgctattcttagaaaccacggcagtctcatgacttcagagacgtgctcgtgggttccgaagtattgtaacttcgcttcattctggcctttcaggtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaata

SEQ ID NO: 305276 - DNA, 3532 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgagtggggacctggatgtgggggagagggacgtgggtgaaagggacgtgggttccgaagacaggaagcgctattcttagaaaccacggcagtctcatgacttcagagacgtgctcgtgggttccgaagtattgtaacttcgcttcattctggcctttcagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaaaaaaaaaaaaaaaaaaaaaaaaaaaaaaaaaaaaaaaaaagggggggggccggggcccgggaaagtttttagagacaatctgggggttggggggggcgcgcgcgcccaagagggttacggtgaccatcgggggcactagacgggggtcccaaaggagaacacgccggggaccaagagagaaagggcgtctggggttttcacaccaataaaaaaaaaccgcgccggggggcacacggagcgggcttctgtggagaccaacactcccaagagggggcgctagagaggcgccgatagcggggtcatcaccaaagaggggtgtccaggggggagggcgaaaaataaaaataagccgtgggggggggggaacacactagccagccgaaagccaagcacgaggagagaaagacagaacagaaagagaacaagacagcaaggcaagcagacacgaagaacagagcacgacgagaaagcacaagaaagcggaaacaacacagcaaggaaaaagaccgtaacagagacgaaacgacgacaaaaacgacaagaaaagaaacacgacaaaacagaaaaccaacaaggcaaacaagaaca

SEQ ID NO: 305277 - DNA, 3576 bp, Homo sapiens
  misc_feature (29)..(29): n is a, c, g, or t
  misc_feature (37)..(37): n is a, c, g, or t
cctgggtgactagaggatcccgaagcgcngaagggcnccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 305278 - DNA, 3781 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatgccccatgaagagggacaaagaatgggatataggagtgcacagcccagcctgacctgtgacatctctgtgtttcagtcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 305279 - DNA, 3590 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 305280 - DNA, 3758 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacgagagaagtggagatcctgatgtttctcagtgccattgtgatgatgaagaaccgcagatccatgccccatgaagagggacaaagaatgggatataggagtgcacagcccagcctgacctgtgacatctctgtgtttcagtcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 305281 - DNA, 3724 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcgagaacttctgggccctgcaggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 305282 - DNA, 2589 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttaaaaaaaaaaaaaaaaaaaaaaaaaaaaaaaaaaaaaaaaaaggggggggagggcagaagaaagatactctcccagggggggccaaagaactagaggcggcaccccgagttatgtggcacaaagggggacccataaggagagaagaaacatatacacagcaaagaaaaaggacaagaacataaaacaagacagaagacggtggcaaaaaaccccacaccacgaggacacaaacaggaacaggagaccacaaaacacacaaggagagaggagacaaaaagagaaacaaaaaaactaaaaagaaattataaaaaactacacagggaaacagtaaaacatgtacaagagataaaaatggggaaaaaacaagaagaaaataagacagacaaataacacatagagacaaagaaagaagaaaaaggaaacacataagacaccaggggactgccgaacacaaaacagcgaaaaccgaacaaagaacgaaaaccaaccaccacagaacgagcaccgacgcaacagaaaaccacaaaacaaacaggagcccagccaacagagccacaacactacagagagacacgcaggagcaaaacagccaaggacacagaggaagaagggaagaaagagaaaaacgacgcagccaatagagcgaggcgaagagacgagagaaagaccaaagaagagaatgaagaagcagaggaagaagacaacgagagtaataaagaaagagtgaatgagcggcagaatagacagaggaggacggaaagagaagaagacagagaaacgagaaagcgagacaagtggagaaagacgaagagcagatgcgagaacagtcaggagaaaagaaggagtaagaagaagagaatatgaattaaaa

SEQ ID NO: 305283 - DNA, 2028 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttaaaaaaaaaaaaaaaaaaaaaaaaaaaaaaaaaaaaaaaaaaggggaaaaaaaaaaaaaaaaaaaaaaaaaaaaagagctgggcgggcgcgcgccccgcggcgcccgaggagagagagagctttttgaacacaaccacctgtgtgggagggcgcgcgagcgcgcgcgcccacgaaagagagagagagacggagagaaaagagaggtggatcaatagagcggtgtgtccccacgagagagaaacaaacacgcggggaaaaaaaaaaagagcggagagggagaaaccacacccccaccaaaaaaaaaagacgt

SEQ ID NO: 305284 - DNA, 1910 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttatctcaaaaaaaaaaaaaagaaatttttgtaacccttagtgtgctttataaacaacggaaatcagttccagtttggaaggctgaaaccccaaaataaaagcaccagttagatgcaccctctttggtgaggttgatggccccataatgaggctgtgcccctgcccgtgtgacggatgacctcccaaatgcccca

SEQ ID NO: 305285 - DNA, 3801 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatgccccatgaagagggacaaagaatgggatataggagtgcacagcccagcctgacctgtgacatctctgtgtttcagtcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcgagaacttctgggccctgcaggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 305286 - DNA, 3340 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccagtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 305287 - DNA, 3022 bp, Homo sapiens
ggatgttgcaagctaggcagtggtcgacatgcgagaacgtctggactggtcaccctgggcaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 305288 - DNA, 3153 bp, Homo sapiens
gtgttaggttccctgtcagttaattggaggtaataacccctggcttacagggttgttttgcagattacattaaataatttaggtataattcttggcacggtgattggcacataatgggtatttaactattagttgacttttctgggtacctaaaaaagaggaaggttagggaagatttttgtcctttgcttactccttcctttcccagactttgtgtaaaatacctcttacttcccaggctctttactctcccttccaacccagatcctgacgtgtgcatctcttttgtgcaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 305289 - DNA, 2929 bp, Homo sapiens
gctgtatctagaggatccctttctctgatcgctcaagaaaggacgggctgtctcatggacttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 305290 - DNA, 1553 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttaagggaaacaccgggtaccgagct

SEQ ID NO: 305291 - DNA, 3405 bp, Homo sapiens
gcgctgttgtattcttctgtgttcatttttcttgttgtgttcgcatgtttgtttttctcgtgtttgtttgttttcgtttgttctgtgctgtcttcctctgtcttgtttcattctgtttgctcctggtttgtttgtgttccttttctttctttttgtctttattctttcttgtttcttggttgtctggttttttcgtccgcctcttctgttggtgtgtttcttcgtggtttcttcgtattattttgtggctgttcttttttttctgtcggtggtgttttctttttttctcttttcttttgtgtttttttattgatttcatgttgattttttttgttggttttcaaaatgttattctcattccttcttacttactggtaaagcaattcaacctgagttttggtggatcattttcatattgggttaatgtgattagtttccagtgattttgtctccttcctagttttaaccaatcatcaaaaggtaatttctctatatctctttattcaatccccttcttccaattctcctctatactacgttggtttttgtttcaattactttatttctaatcgactaatcacttttttgctttaacctttttctccttatggatctagcgactaattctatgacttatactttttaatcgcagaccatatactcgaacccagacaagtagccttccacggaagcaattattcctatgcctgttattcttctctcctccgtctctactaccacagcatattaccttattgctataaatctagctctttaccaagctcgtgcatgtatctactgagcaaattgctttgaaacccagagtcatggtaccactgacagtctcatactaatacagcacttaacacagtaacccatcgtgcgcaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 305292 - DNA, 1335 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggtacctgaaaggaagggcaggtgcatgaagggtgcagaacagtaggtgggctttcaagccctacccgggtttgattcacagctctgccacttgcccattagctttgagggtgtggactagttactagacctcatgttttaattcatttagcaaatatatattatgtgcagacctgctagtactgggtaacaatcattagttaagatttggtctcaggccaggcacggtggctcacgcctgtaatcccagcactttgggaggccgaggctggcagatcacctgaggtcaggagtttgagaccagcctgaccaacatggagaaaccccgtgtctactaaaaatacaaaaatagccgagtgtggtggcgcatgcctataatgccagctatttgggaggctgaggcaggagaatcgcttgaacccgggaggtggaggttgcagtgagctgagattgcaccattgcggtccagcctgggcaacaagagactccatc

SEQ ID NO: 305293 - DNA, 787 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcgcaaagtgggcacatcacccctcaccaagaactccacaatccaagtgaccctcttgtcccaacggggaggaacg

SEQ ID NO: 305294 - DNA, 1251 bp, Homo sapiens
ggatccgaattcggatccacggatcaacatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttaaaaaaaaaaaaaaaaaaaaaaaaaaaaaaaaaaaaaaaaaaggggggggagggcagaagaaagatactctcccagggggggccaaagaactagaggcggcaccccgagttatgtggcacaaagggggacccataaggagagaagaaacatatacacagcaaagaaaaaggacaagaacataaaacaagacagaagacggtggcaaaaaaccccacaccacgaggacacaaacaggaacaggagaccacaaaacacacaaggagagaggagacaaaaagagaaacaaaaaaactaaaaagaaattataaaaaactacacagggaaacagtaaaacatgtacaagagataaaaatggggaaaaaacaagaagaaaataagacagacaaataacacatagagacaaagaaagaagaaaaaggaaacacataagacaccaggggactgccgaacacaaaacagcgaaaaccgaacaaagaacgaaaaccaaccaccacagaacgagcaccgacgcaacagaaaaccacaaaacaaacaggagcccagccaacagagccacaacactacagagagacacgcaggagcaaaacagccaaggacacagaggaagaagggaagaaagagaaaaacgacgcagccaatagagcgaggcgaagagacgagagaaagaccaaagaagagaatgaagaagcagaggaagaagacaacgagagtaataaagaaagagtgaatgagcggcagaatagacagaggaggacggaaagagaagaagacagagaaacgagaaagcgagacaagtggagaaagacgaagagcagatgcgagaacagtcaggagaaaagaaggagtaagaagaagagaatatgaattaaaa

SEQ ID NO: 305295 - DNA, 872 bp, Homo sapiens
ggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccagtaagtttagttcacttctcagactcaaggttagatctaatgccctttggaggtgctttgcttcatgttaagagagtggcaatcatttggtaaatttgtcctacgtttaattccaaggctgaatttgaacttggacttctatcccctccctgtctcctatttcaaagtgccccatgaagagggacaaagaatgggatataggagtgcacagcccagcctgacctgtgacatctctgtgtttcagtcactgtggagcaacatataggcaacattttcatgtttagtaaagtggccaacacaattcttttcttccgcttggatattcgcatgggcctactttacatcacactctgcataggtgaggagactgcctttctttctttttttttttttgtaagactgtgttgatagacttgattgtggaaaccacagtcccaacagttgcaatcccaaacatgtttctccatacccttcttccatatctcatacctaatgaattatatatgtagctcagatgataac

SEQ ID NO: 305296 - DNA, 521 bp, Homo sapiens
taaggctttttatgtttccttcgacatcttctttctgtatttagtgttcctgatgacgtgcaaaccccccctatatatgggccctgagtatatcaagtacttcaatgataaaaccattgatgtgagtgctctttcccctttctgtttcttgggtcccttgtgggtgattttgtagttgtgctctccattcactaggaggaacaacagtgcttcaaaatggatgtcacgggcactgtggttcattatgagagccgggggagagggaacaccaggatgaggaattagatgctaaagtctgaaccttcccaggaggctatgtggatccagctgacttttcttccctgtatttggcaggaggaactagaacgggacaagagggtcacttggattgtggagttctttgccaattggtctaatgactgccaatcatttgcccctatctatgctgacctctcccttaagtgagtagtgcaaagggagggatggtggaaatggagatgctgtgccttccctctcactgt

SEQ ID NO: 305297 - DNA, 561 bp, Homo sapiens
tacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttga

SEQ ID NO: 305298 - DNA, 811 bp, Homo sapiens
cgctaagcggggaggagcgaccgctacaatggatcctcccgcaggctttgtgcgcgctgggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatgacaacagtgagctgggacggagacaagctccagtgtgtgcagaagggtgagaaggaggggcgtggctggacccagtggatcgagggtgatgagctgcacctggagatgagagtggaaggtgtggtctgcaagcaagtattcaagaaggtgcagtgaggcccaggcagacaaccttgtcccaaggaatcagcaggatgtgtgggccaggatccccctctttgcacagcatgaggcaaaaatgtccagccacccccaggcatctgttagcagagtctgtctcttggctttgtcacttttccttttcttaaaacaaagccatgccaataaagtgatctgtgttcaaaa

SEQ ID NO: 305299 - DNA, 1059 bp, Homo sapiens
cgctaagcggggaggagcgaccgctacaatggatcctcccgcaggctttgtgcgcgctgggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatgacaacagtgagctgggacggagacaagctccagtgtgtgcagaagggtgagaaggaggggcgtggctggacccagtggatcgagggtgatgagctgcacctggagatgagagtggaaggtgtggtctgcaagcaagtattcaagaaggtgcagtgaggcccaggcagacaaccttgtcccaaggaatcagcaggatgtgtgggccaggatccccctctttgcacagcatgaggcaaaaatgtccagccacccccaggcatctgttagcagagtctgtctcttggctttgtcacttttccttttcttaaaacaaagccatgccaataaagtgatctgtgttcaaaaaaaaaacaaaaaaaaaaaaaaaaaaaaaaaaacccggggggatctaatagtggggggagggggaaaaaaggggaaagaaagggggcactgggccaaagcgagttttccgctggcacacaattttttgtggtaacaagggtgggaacatatcgcggcgaggatccccaataaagggagggccgcagagattaaaatccgcgaaaaacgcgcgggttatacccctgttataaacacgcggaacagaaggt

SEQ ID NO: 305300 - DNA, 689 bp, Homo sapiens
cgctaagcggggaggagcgaccgctacaatggatcctcccgcaggctttgtgcgcgctgggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatgacaacagtgagctgggacggagacaagctccagtgtgtgcagaagggtgagaaggaggggcgtggctggacccagtggatcgagggtgatgagctgcacctgagatcaaagtgacatgcgtgctctgtaagcacttattgaacagggtgccaagctggccaggctcacaacctatgacgaatggattaccaccaagttttccccaggaatcccttgttcagtc

SEQ ID NO: 305301 - DNA, 550 bp, Homo sapiens
caaagccaagaaggattctctaagcttctctaagatatgatctcaatctgggtcagcgggaggtgattcgggaggggaagcgtcaaggggtcctgttggtcagctctgagccacatccattcctctcagccagctctgtctgtaggatgctgcagagcactccactatacagtttaactgtctttccaaacaattggttacttaaaccaactcttggggaaaaataacagccaatgagtatttttagagttcttgccgtaagtgtgactctgctctggccaatgaccaacatctgcttttgtttcaggagatgagagtggaaggtgtggtctgcaagcaagtattcaagaaggtgcagtgaggcccaggcagacaaccttgtcccaaggaatcagcaggatgtgtgggccaggatccccctctttgcacagcatgaggcaaaaatgtccagccacccccaggcatctgttagcagagtctgtctcttggctttgtcacttttccttttcttaaaacaaagccatgccaataaagtgatctgtgttcaaaa

SEQ ID NO: 305302 - DNA, 935 bp, Homo sapiens
cgctaagcggggaggagcgaccgctacaatggatcctcccgcaggctttgtgcgcgctgggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatggctggagtgcaatcgcgtgatctcagctcactgtaacctctgcctcccgggttcaagcaattctcctgcctcagcctcccaagtagctgggattacagtcacacgccaccacacctggataattttgtatttttggtagagacagggtttcactatgttggtcaggctggtctcaaactcctgagctcaggtgatccatctgcctcagcctcccaaaatgctgggattacaagtgtgagccactacacctggttcttctttccactgtttgctaactcccatggtgttttctggcatcacttccagcattatttctagccttacctcttccaggaagccttccctgatgggcctctgtctctaccttaaaggctgtcgaggtgccttctgacttccataacctccagcatttgtctaccagtacttaccattctgctggaattctctgtcttcttaccttcttctcaga

SEQ ID NO: 305303 - DNA, 760 bp, Homo sapiens
cgctaagcggggaggagcgaccgctacaatggatcctcccgcaggctttgtgcgcgctgggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatgacaacagtgagctgggacggagacaagctccagtgtgtgcagaagggtgagaaggaggggcgtggctggacccagtggatcgagggtgatgagctgcacctgtgaggcccaggcagacaaccttgtcccaaggaatcagcaggatgtgtgggccaggatccccctctttgcacagcatgaggcaaaaatgtccagccacccccaggcatctgttagcagagtctgtctcttggctttgtcacttttccttttcttaaaacaaagccatgccaataaagtgatctgtgttcaaaa

SEQ ID NO: 305304 - DNA, 779 bp, Homo sapiens
cgctaagcggggaggagcgaccgctacaatggatcctcccgcaggctttgtgcgcgctgggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatgacaacagtgagctgggacggagacaagctccagtgtgtgcagaagggtgagaaggaggggcgtggctggacccagtggatcgagggtgatgagctgcacctgcctggtaggttcctgggctgggtcaggccgggtccccagaggccctggtcattgttgaggtccagatggaccttggaaaaaggcaccatggatgggccttggttctgttctaaagcttctcttccaagggcctggaaaagatgcctgggtgactttaaaaaccaagcaatgtattttcaaggtctaggctgacccaatcatctaatcagag

SEQ ID NO: 305305 - DNA, 749 bp, Homo sapiens
caaaattacttatgtgtattagtcagatattttaaaggaatgaaaatgatgtaatttagaagaaaatagcttaaacctgttgtttcaagaatttatataagagacctgacactgaatttttatggattacttacaaactaatgtaaacatttctttttagttattctttctcttttaaagtgttgataagtgaattttgttagctatttggttgttaagtaaaaactggcttatttgctcaaacttgcaaagtatctctggaagaatatttaggaaactggcaacgttgctttcagagaaaggaaatggatatctcggggtgggaagggagggaaactttgaattttgaataccctttgaatttttgagtcatgaactattagaaataaagtaaattaaaatttaacaagaaaaatgaacctccgtgatcagcttagcattgtcagtcctgaaataatcttttgtgacctccatgatcagcttagcattatccggcctggaatatcttgagactcagcatacagcggatgtatgtaatggcaggtgcaaacaaacagaaaggtaaccaaatacaagtatttatgctgtacttactctattagaataaattagttaacataatatatacctctttttatcaaattggaaattaaactattggataactgttagattttttttcccccctataactattaaaattttttttaaaatcttgctactgcccattagaaaggatttgggaacat

SEQ ID NO: 305306 - DNA, 3381 bp, Homo sapiens
aggctgggggacaaccagaggccagggagaaagaggagacagaggaagcaccgagggtgactacgttgtcttccctagatcaattttcttctggatggctcgtgctgagtggtagatgagcgaatcgatgagtccagccactgtgaacatgcccccaatgatggcgcacacacctgtcaggaagtgggtgaaggacctgtgcttctccgtcagcttcaccatcatgggcgagagctcatagaggacgaagactccgggaaggccttggtcgcccaacagcccattggcaaccttctcatgtctggtcacagagaactgatttgtcctcagtacctctccgtccaccttcatgtacacagtgggcaccaccttcacaaagtgctgtaacacctgtgaaggcagcggctccggcgcgagcgcgaggctgcagcccccgagtttcccggccgtcttcgccccctctccccctcctttcttcttctctgcctctcctgcctctcgccgctgctcctcccgcgctctccggctctgaatctcgaccttaatttatttccccctaccctgcccgctccctcgcgtgcccaatcgcccggccggcgcgggccccgcggcgccgcctcccctcccccacgcgcgccccctccccgccggcgacccgagggccgcagctgggccgccgccgccgtttcctgcgagccagcctgagcgcaacacttctccgagccagcgagccagcgagccgccgacccgccgagcaaaatgggaaatgaggcaagttatcctttggaaatgtgctcacactttgatgcggatgaaattaaaaggctaggaaagagatttaagaagcttgatttggacaattctggttctttgagtgtggaagagttcatgtctctgcctgagttacaacagaatcctttagtacagcgagtaatagatatattcgacacagatgggaatggagaagtagactttaaagaattcattgagggcgtctctcagttcagtgtcaaaggagataaggagcagaaattgaggtttgctttccgtatctatgacatggataaagatggctatatttccaatggggaactcttccaggtattgaagatgatggtggggaacaatctgaaagatacacagttacagcaaattgtagacaaaaccataataaatgcagataaggatggagatggaagaatatcctttgaagaattctgtgctgttgtaggtggcctagatatccacaaaaagatggtggtagatgtgtgactcttatcagagagtaccacccaacacttttgctttcttctccatctctgaagatctgctcaagacgtccagcaatgctctctgtgtatttaaatggaagtatttttctctgtgaagccacattttccaacatgagcctcatgaagccaactaagtgttattgaactgtaattctctcaataactcagtgtagcactttaaagtctgaaggacagcaacatgaaaagagcatatcaatgtggtggagaaagggaaggggttggctttttaatttatttttcttcatcttttataacaagaaagtatctatatatacatatgtaaatatttatatatagatatatgtagctttctatatatgtagtaggttggctttaatttaatatacttgattcagaaacaaaacaatagagtacaaaagtgccaagcagaacataaaacatccttacttttatttcacacagttttatatatagatagaagactgtacaatttgagccgggtgttaggccagctattttccttttcctgtgctttctcctttgagagattgacaaagcatttgttaacgtcctattatttaccttaattacatttttgtaacaaaggagtctgtaactttatttatacttatgaatatatccagggactacttctcattgctgagcagcttttaatacacctctgcttgaggagaaagtctagttcattgctactgccaagagctagttcttgtgttcatatagtaactgcacagggcttatagctgcttcattctgctactttgtaactaggagccattgcatttattaaatgtccctcagtaacgttaagtgctagttgtgattttatacataaaggccagaagctgtctgaggcaatcatgattgattgtatgtatcacttactgaagaatacctgaagtgatcatgtaactacttataagggatatccatttgtttgattacatgggtaaataatttgtcattaaacttgtgtttgaatcatgaattcccttgtttcaaaagacttgcagctaatctaaaaaactggtgatatttaatatgcatgtatgtatctaaacacccacatatatttgtggtttaagtgtgagaaatcttgctaatctatatgccacagaagagcaaaattgtatccaaatttatgccacttaaatttctttaccacgagggatagagcatgcatactggtttttttttcttgatttgcccatataattggtaatggataacttaataaatttgtgtgatataaaagtagtgtatcatgttctactgtttgatcttatcccttcccatttctgcaaaggtactgttagctggaagaaaaacattttggttagctttgtatgacagtagtctttccctttatagtttctctataaaaactggttttaaaatcagtggaaaagggcaggttgaatcaaggtgaatcaatctgaaattgagcacacctgcctgccatcgctgttccttcaactgagtgctgcacatcatgggctctgtctgtgagagaaaaatcccggtgcttggtgtccttgcatgacatggagttttgcatgtagatcaatttaaaatgtacctcttgtttacataatttgcataattttaaaagataatgttgccaaactttggaaatgttaatgttcagactgaaaatctccactacatgtaactttcttcctctggatcagtggcatggcttataatcccagccagtggtttgaactgttccagtgtcaactgccatgtgctctgcttcaagggggaactagccttttgtgaattttttgtacataagtatttgttacaaatattttagcaaatgctttctatttctcttgcttgtgcatatcttggctggcgttacagaaaaatagtgtaaacattatttccttaccggggaatgagggttttttctttttcttttttttttttttttttttttttagtttgtgtgtgggggtgggtaagggaggggatggtttatgttgaatgtttagtttttcttctgcatgatacgtcatgttgtgggatctttagaaaacttcatactgtatgaataagaaaataaaatatttgaaacttg

SEQ ID NO: 305307 - DNA, 3909 bp, Homo sapiens
aggctgggggacaaccagaggccagggagaaagaggagacagaggaagcaccgagggtgactacgttgtcttccctagatcaattttcttctggatggctcgtgctgagtggtagatgagcgaatcgatgagtccagccactgtgaacatgcccccaatgatggcgcacacacctgtcaggaagtgggtgaaggacctgtgcttctccgtcagcttcaccatcatgggcgagagctcatagaggacgaagactccgggaaggccttggtcgcccaacagcccattggcaaccttctcatgtctggtcacagagaactgatttgtcctcagtacctctccgtccaccttcatgtacacagtgggcaccaccttcacaaagtgctgtaacacctgtgaaggcagcggctccggcgcgagcgcgaggctgcagcccccgagtttcccggccgtcttcgccccctctccccctcctttcttcttctctgcctctcctgcctctcgccgctgctcctcccgcgctctccggctctgaatctcgaccttaatttatttccccctaccctgcccgctccctcgcgtgcccaatcgcccggccggcgcgggccccgcggcgccgcctcccctcccccacgcgcgccccctccccgccggcgacccgagggccgcagctgggccgccgccgccgtttcctgcgagccagcctgagcgcaacacttctccgagccagcgagccagcgagccgccgacccgccgagcaaaatgggaaatgaggcaagttatcctttggaaatgtgctcacactttgatgcggatgaaattaaaaggctaggaaagagatttaagaagcttgatttggacaattctggttctttgagtgtggaagagttcatgtctctgcctgagttacaacagaatcctttagtacagcgagtaatagatatattcgacacagatgggaatggagaagtagactttaaagaattcattgagggcgtctctcagttcagtgtcaaaggagataaggagcagaaattgaggtttgctttccgtatctatgacatggataaagatggctatatttccaatggggaactcttccaggtattgaagatgatggtggggaacaatctgaaagatacacagttacagcaaattgtagacaaaaccataataaatgcagataaggatggagatggaagaatatcctttgaagaattctgtgctgttgtaggtggcctagatatccacaaaaagatggtggtagatgtgtgactcttatcagagagtaccacccaacacttttgctttcttctccatctctgaagatctgctcaagacgtccagcaatgctctctgtgtatttaaatggaagtatttttctctgtgaagccacattttccaacatgagcctcatgaagccaactaagtgttattgaactgtaattctctcaataactcagtgtagcactttaaagtctgaaggacagcaacatgaaaagagcatatcaatgtggtggagaaagggaaggggttggctttttaatttatttttcttcatcttttataacaagaaagtatctatatatacatatgtaaatatttatatatagatatatgtagctttctatatatgtagtaggttggctttaatttaatatacttgattcagaaacaaaacaatagagtacaaaagtgccaagcagaacataaaacatccttacttttatttcacacagttttatatatagatagaagactgtacaatttgagccgggtgttaggccagctattttccttttcctgtgctttctcctttgagagattgacaaagcatttgttaacgtcctattatttaccttaattacatttttgtaacaaaggagtctgtaactttatttatacttatgaatatatccagggactacttctcattgctgagcagcttttaatacacctctgcttgaggagaaagtctagttcattgctactgccaagagctagttcttgtgttcatatagtaactgcacagggcttatagctgcttcattctgctactttgtaactaggagccattgcatttattaaatgtccctcagtaacgttaagtgctagttgtgattttatacataaaggccagaagctgtctgaggcaatcatgattgattgtatgtatcacttactgaagaatacctgaagtgatcatgtaactacttataagggatatccatttgtttgattacatgggtaaataatttgtcattaaacttgtgtttgaatcatgaattcccttgtttcaaaagacttgcagctaatctaaaaaactggtgatatttaatatgcatgtatgtatctaaacacccacatatatttgtggtttaagtgtgagaaatcttgctaatctatatgccacagaagagcaaaattgtatccaaatttatgccacttaaatttctttaccacgagggatagagcatgcatactggtttttttttcttgatttgcccatataattggtaatggataacttaataaatttgtgtgatataaaagtagtgtatcatgttctactgtttgatcttatcccttcccatttctgcaaaggtactgttagctggaagaaaaacattttggttagctttgtatgacagtagtctttccctttatagtttctctataaaaactggttttaaaatcagtggaaaagggcaggttgaatcaaggtgaatcaatctgaaattgagcacacctgcctgccatcgctgttccttcaactgagtgctgcacatcatgggctctgtctgtgagagaaaaatcccggtgcttggtgtccttgcatgacatggagttttgcatgtagatcaatttaaaatgtacctcttgtttacataatttgcataattttaaaagataatgttgccaaactttggaaatgttaatgttcagactgaaaatctccactacatgtaactttcttcctctggatcagtggcatggcttataatcccagccagtggtttgaactgttccagtgtcaactgccatgtgctctgcttcaagggggaactagccttttgtgaattttttgtacataagtatttgttacaaatattttagcaaatgctttctatttctcttgcttgtgcatatcttggctggcgttacagaaaaatagtgtaaacattatttccttaccggggaatgagggttttttctttttcttttttttttttttttttttttttagtttgtgtgtgggggtgggtaagggaggggatggtttatgttgaatgtttagtttttcttctgcatgatacgtcatgttgtgggatctttagaaaacttcatactgtatgaataagaaaataaaatatttgaaacttgcttgaatgtattcagtggtctttgatggtttccatagctatgagaattttttttcctctcaggcttttaaattcttaaaaacagtctggtaaagtgacatttaatctctataaaaacctacaaattcctgtagtactctcccatcacctcctgccatgacttcccttactgctacccctctctctactccagccatgttagcctccggtggtacctgggagtcttggggtttgtgtctcttaggcccttgcgctatcagtccctttttgcccctttcctttcccagtatctcatagctaatgccttcaggtgtttgttcagttacagcctagctcaaaaggaactgtcctggctaccctattaaaaaatacagatacgcctggctcttctttcctcctctatatttttccttctacaatggcatttattcttttctgacacagtttacttacgtattttgtattccctgactactgaataaaatgaaagctccaaaagggtagtgatttgtctcttgttcactgatag

SEQ ID NO: 305308 - DNA, 3912 bp, Homo sapiens
  misc_feature (3084)..(3084): n is a, c, g, or t
  misc_feature (3094)..(3094): n is a, c, g, or t
  misc_feature (3096)..(3100): n is a, c, g, or t
  misc_feature (3105)..(3105): n is a, c, g, or t
  misc_feature (3110)..(3114): n is a, c, g, or t
  misc_feature (3119)..(3120): n is a, c, g, or t
  misc_feature (3125)..(3125): n is a, c, g, or t
  misc_feature (3131)..(3132): n is a, c, g, or t
aggctgggggacaaccagaggccagggagaaagaggagacagaggaagcaccgagggtgactacgttgtcttccctagatcaattttcttctggatggctcgtgctgagtggtagatgagcgaatcgatgagtccagccactgtgaacatgcccccaatgatggcgcacacacctgtcaggaagtgggtgaaggacctgtgcttctccgtcagcttcaccatcatgggcgagagctcatagaggacgaagactccgggaaggccttggtcgcccaacagcccattggcaaccttctcatgtctggtcacagagaactgatttgtcctcagtacctctccgtccaccttcatgtacacagtgggcaccaccttcacaaagtgctgtaacacctgtgaaggcagcggctccggcgcgagcgcgaggctgcagcccccgagtttcccggccgtcttcgccccctctccccctcctttcttcttctctgcctctcctgcctctcgccgctgctcctcccgcgctctccggctctgaatctcgaccttaatttatttccccctaccctgcccgctccctcgcgtgcccaatcgcccggccggcgcgggccccgcggcgccgcctcccctcccccacgcgcgccccctccccgccggcgacccgagggccgcagctgggccgccgccgccgtttcctgcgagccagcctgagcgcaacacttctccgagccagcgagccagcgagccgccgacccgccgagcaaaatgggaaatgaggcaagttatcctttggaaatgtgctcacactttgatgcggatgaaattaaaaggctaggaaagagatttaagaagcttgatttggacaattctggttctttgagtgtggaagagttcatgtctctgcctgagttacaacagaatcctttagtacagcgagtaatagatatattcgacacagatgggaatggagaagtagactttaaagaattcattgagggcgtctctcagttcagtgtcaaaggagataaggagcagaaattgaggtttgctttccgtatctatgacatggataaagatggctatatttccaatggggaactcttccaggtattgaagatgatggtggggaacaatctgaaagatacacagttacagcaaattgtagacaaaaccataataaatgcagataaggatggagatggaagaatatcctttgaagaattctgtgctgttgtaggtggcctagatatccacaaaaagatggtggtagatgtgtgactcttatcagagagtaccacccaacacttttgctttcttctccatctctgaagatctgctcaagacgtccagcaatgctctctgtgtatttaaatggaagtatttttctctgtgaagccacattttccaacatgagcctcatgaagccaactaagtgttattgaactgtaattctctcaataactcagtgtagcactttaaagtctgaaggacagcaacatgaaaagagcatatcaatgtggtggagaaagggaaggggttggctttttaatttatttttcttcatcttttataacaagaaagtatctatatatacatatgtaaatatttatatatagatatatgtagctttctatatatgtagtaggttggctttaatttaatatacttgattcagaaacaaaacaatagagtacaaaagtgccaagcagaacataaaacatccttacttttatttcacacagttttatatatagatagaagactgtacaatttgagccgggtgttaggccagctattttccttttcctgtgctttctcctttgagagattgacaaagcatttgttaacgtcctattatttaccttaattacatttttgtaacaaaggagtctgtaactttatttatacttatgaatatatccagggactacttctcattgctgagcagcttttaatacacctctgcttgaggagaaagtctagttcattgctactgccaagagctagttcttgtgttcatatagtaactgcacagggcttatagctgcttcattctgctactttgtaactaggagccattgcatttattaaatgtccctcagtaacgttaagtgctagttgtgattttatacataaaggccagaagctgtctgaggcaatcatgattgattgtatgtatcacttactgaagaatacctgaagtgatcatgtaactacttataagggatatccatttgtttgattacatgggtaaataatttgtcattaaacttgtgtttgaatcatgaattcccttgtttcaaaagacttgcagctaatctaaaaaactggtgatatttaatatgcatgtatgtatctaaacacccacatatatttgtggtttaagtgtgagaaatcttgctaatctatatgccacagaagagcaaaattgtatccaaatttatgccacttaaatttctttaccacgagggatagagcatgcatactggtttttttttcttgatttgcccatataattggtaatggataacttaataaatttgtgtgatataaaagtagtgtatcatgttctactgtttgatcttatcccttcccatttctgcaaaggtactgttagctggaagaaaaacattttggttagctttgtatgacagtagtctttccctttatagtttctctataaaaactggttttaaaatcagtggaaaagggcaggttgaatcaaggtgaatcaatctgaaattgagcacacctgcctgccatcgctgttccttcaactgagtgctgcacatcatgggctctgtctgtgagagaaaaatcccggtgcttggtgtccttgcatgacatggagttttgcatgtagatcaatttaaaatgtacctcttgtttacataatttgcataattttaaaagataatgttgccaaactttggaaatgttaatgttcagactgaaaatctccactacatgtaactttcttcctctggatcagtggcatggcttataatcccagccagtggtttgaactgttccagtgtcaactgccatgtgctctgcttcaagggggaactagccttttgtgaatttttnccacaccaancnnnnnccccnccacnnnnnccccnnccccncctatnncccccccccccccccccccctccctggcgttacagaaaaatagtgtaaacattatttccttaccggggaatgagggttttttctttttcttttttttttttttttttttttttagtttgtgtgtgggggtgggtaagggaggggatggtttatgttgaatgtttagtttttcttctgcatgatacgtcatgttgtgggatctttagaaaacttcatactgtatgaataagaaaataaaatatttgaaacttgcttgaatgtattcagtggtctttgatggtttccatagctatgagaattttttttcctctcaggcttttaaattcttaaaaacagtctggtaaagtgacatttaatctctataaaaacctacaaattcctgtagtactctcccatcacctcctgccatgacttcccttactgctacccctctctctactccagccatgttagcctccggtggtacctgggagtcttggggtttgtgtctcttaggcccttgcgctatcagtccctttttgcccctttcctttcccagtatctcatagctaatgccttcaggtgtttgttcagttacagcctagctcaaaaggaactgtcctggctaccctattaaaaaatacagatacgcctggctcttctttcctcctctatatttttccttctacaatggcatttattcttttctgacacagtttacttacgtattttgtattccctgactactgaataaaatgaaagctccaaaagggtagtgatttgtctcttgttcactgatag

SEQ ID NO: 305309 - DNA, 3083 bp, Homo sapiens
gccccgcgcgctgcagcactccgctttcccctccctctccgccctccccttttttcgtgccttgaggttgcgggtcagcgcgagccgctgcagtgagtccgtcacggctccggcgcgagcgcgaggctgcagcccccgagtttcccggccgtcttcgccccctctccccctcctttcttcttctctgcctctcctgcctctcgccgctgctcctcccgcgctctccggctctgaatctcgaccttaatttatttccccctaccctgcccgctccctcgcgtgcccaatcgcccggccggcgcgggccccgcggcgccgcctcccctcccccacgcgcgccccctccccgccggcgacccgagggccgcagctgggccgccgccgccgtttcctgcgagccagcctgagcgcaacacttctccgagccagcgagccagcgagccgccgacccgccgagcaaaatgggaaatgaggcaagttatcctttggaaatgtgctcacactttgatgcggatgaaattaaaaggctaggaaagagatttaagaagcttgatttggacaattctggttctttgagtgtggaagagttcatgtctctgcctgagttacaacagaatcctttagtacagcgagtaatagatatattcgacacagatgggaatggagaagtagactttaaagaattcattgagggcgtctctcagttcagtgtcaaaggagataaggagcagaaattgaggtttgctttccgtatctatgacatggataaagatggctatatttccaatggggaactcttccaggtattgaagatgatggtggggaacaatctgaaagatacacagttacagcaaattgtagacaaaaccataataaatgcagataaggatggagatggaagaatatcctttgaagaattctgtgctgttgtaggtggcctagatatccacaaaaagatggtggtagatgtgtgactcttatcagagagtaccacccaacacttttgctttcttctccatctctgaagatctgctcaagacgtccagcaatgctctctgtgtatttaaatggaagtatttttctctgtgaagccacattttccaacatgagcctcatgaagccaactaagtgttattgaactgtaattctctcaataactcagtgtagcactttaaagtctgaaggacagcaacatgaaaagagcatatcaatgtggtggagaaagggaaggggttggctttttaatttatttttcttcatcttttataacaagaaagtatctatatatacatatgtaaatatttatatatagatatatgtagctttctatatatgtagtaggttggctttaatttaatatacttgattcagaaacaaaacaatagagtacaaaagtgccaagcagaacataaaacatccttacttttatttcacacagttttatatatagatagaagactgtacaatttgagccgggtgttaggccagctattttccttttcctgtgctttctcctttgagagattgacaaagcatttgttaacgtcctattatttaccttaattacatttttgtaacaaaggagtctgtaactttatttatacttatgaatatatccagggactacttctcattgctgagcagcttttaatacacctctgcttgaggagaaagtctagttcattgctactgccaagagctagttcttgtgttcatatagtaactgcacagggcttatagctgcttcattctgctactttgtaactaggagccattgcatttattaaatgtccctcagtaacgttaagtgctagttgtgattttatacataaaggccagaagctgtctgaggcaatcatgattgattgtatgtatcacttactgaagaatacctgaagtgatcatgtaactacttataagggatatccatttgtttgattacatgggtaaataatttgtcattaaacttgtgtttgaatcatgaattcccttgtttcaaaagacttgcagctaatctaaaaaactggtgatatttaatatgcatgtatgtatctaaacacccacatatatttgtggtttaagtgtgagaaatcttgctaatctatatgccacagaagagcaaaattgtatccaaatttatgccacttaaatttctttaccacgagggatagagcatgcatactggtttttttttcttgatttgcccatataattggtaatggataacttaataaatttgtgtgatataaaagtagtgtatcatgttctactgtttgatcttatcccttcccatttctgcaaaggtactgttagctggaagaaaaacattttggttagctttgtatgacagtagtctttccctttatagtttctctataaaaactggttttaaaatcagtggaaaagggcaggttgaatcaaggtgaatcaatctgaaattgagcacacctgcctgccatcgctgttccttcaactgagtgctgcacatcatgggctctgtctgtgagagaaaaatcccggtgcttggtgtccttgcatgacatggagttttgcatgtagatcaatttaaaatgtacctcttgtttacataatttgcataattttaaaagataatgttgccaaactttggaaatgttaatgttcagactgaaaatctccactacatgtaactttcttcctctggatcagtggcatggcttataatcccagccagtggtttgaactgttccagtgtcaactgccatgtgctctgcttcaagggggaactagccttttgtgaattttttgtacataagtatttgttacaaatattttagcaaatgctttctatttctcttgcttgtgcatatcttggctggcgttacagaaaaatagtgtaaacattatttccttaccggggaatgagggttttttctttttcttttttttttttttttttttttttagtttgtgtgtgggggtgggtaagggaggggatggtttatgttgaatgtttagtttttcttctgcatgatacgtcatgttgtgggatctttagaaaacttcatactgtatgaataagaaaataaaatatttgaaacttg

SEQ ID NO: 305310 - DNA, 1118 bp, Homo sapiens
tagaatcataggaaacccttgctaacaaagattaggaagtataatcgacaggaagtagatagatattgagaatatgcatgtatgtatctaaacacccacatatatttgtggtttaagtgtgagaaatcttgctaatctatatgccacagaagagcaaaattgtatccaaatttatgccacttaaatttctttaccacgagggatagagcatgcatactggtttttttttcttgatttgcccatataattggtaatggataacttaataaatttgtgtgatataaaagtagtgtatcatgttctactgtttgatcttatcccttcccatttctgcaaaggtactgttagctggaagaaaaacattttggttagctttgtatgacagtagtctttccctttatagtttctctataaaaactggttttaaaatcagtggaaaagggcaggttgaatcaaggtgaatcaatctgaaattgagcacacctgcctgccatcgctgttccttcaactgagtgctgcacatcatgggctctgtctgtgagagaaaaatcccggtgcttggtgtccttgcatgacatggagttttgcatgtagatcaatttaaaatgtacctcttgtttacataatttgcataattttaaaagataatgttgccaaactttggaaatgttaatgttcagactgaaaatctccactacatgtaactttcttcctctggatcagtggcatggcttataatcccagccagtggtttgaactgttccagtgtcaactgccatgtgctctgcttcaagggggaactagccttttgtgaattttttgtacataagtatttgttacaaatattttagcaaatgctttctatttctcttgcttgtgcatatcttggctggcgttacagaaaaatagtgtaaacattatttccttaccggggaatgagggttttttctttttcttttttttttttttttttttttttagtttgtgtgtgggggtgggtaagggaggggatggtttatgttgaatgtttagtttttcttctgcatgatacgtcatgttgtgggatctttagaaaacttcatactgtatgaataagaaaataaaatatttgaaacttg

SEQ ID NO: 305311 - DNA, 438 bp, Homo sapiens
ctattagaaataaagtaaattaaaatttaacaagaaaaatgaaaatgaaagtacttcggtttacagaacagaggttgattgaacctgtctggtagaacctccgtgatcagcttagcattgtcagtcctgaaataatcttttgtgacctccatgatcagcttagcattatccggcctggaatatcttgagactcagcatacagcggatgtatgtaatggcaggtgcaaacaaacagaaaggtaaccaaatacaagtatttatgctgtacttactctattagaataaattagttaacataatatatacctctttttatcaaattggaaattaaactattggataactgttagattttttttcccccctataactattaaaattttttttaaaatcttgctactgcccattagaaaggatttgggaacatttttaaaaaat

SEQ ID NO: 305312 - DNA, 426 bp, Homo sapiens
taacataatatatacctctttttatcaaattggaaattaaactattggataactgttagattttttttcccccctataactattaaaattttttttaaaatcttgctactgcccattagaaaggatttgggaacatttttaaaaaattcttgcttccttttttgtttgcttttagttgatgcggatgaaattaaaaggctaggaaagagatttaagaagcttgatttggacaattctggttctttgagtgtggaagagttcatgtctctgcctgagttacaacagaatcctttagtacagcgagtaatagatatattcgacacagatgggaatggagaagtagactttaaaggtaagaaagtagttattttttataaccacaagttatctaacctatttgtattcttacagctctgtgtaaaaaaa

SEQ ID NO: 305313 - DNA, 436 bp, Homo sapiens
gcggccgccatgtggtgcctgcactgcaactcggagaggacccagtcccttctggagctagagcttgacagcggatgaggaaagaatggctagaaaatgaaaatgacgaattcaagctctgcagaatatagacctggtcctctggtaaatgcatggaccctctttcccctccctggcattgctggggagcagcttgttagaatgcagcctgaggcagaggcagggaggagcagggggccaaggaggagccggagagacaaaacctgcaggccccagctgtgcgcactccagtggcagcattgggttccctgtacagccaccgtggatggctacagaggtgcactaccatcagcagagtggaaggagaatccttggaagctctacccagtgcctacaatctcaaaaacatgttcgccagccccaggaagtcatctgg

SEQ ID NO: 305314 - DNA, 4419 bp, Homo sapiens
gcggccgccatgtggtgcctgcactgcaactcggagaggacccagtcccttctggagctagagcttgacagcggcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccgggaagcgagggcgtcgcagcagtgcgggatcgctagagagcaatgtggaatttcagcctttcgagccactgcagccgtcagtgctgtgctcctaagccatgggacccgaggactgccccccggcgcctgcccaggcggaggccctttcagaaagggcgaagctcacgcctgactctgcgggccgcggggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctttgtctcgcaattttgaggaggttgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattattgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgca

SEQ ID NO: 305315 - DNA, 4491 bp, Homo sapiens
  misc_feature (72)..(72): n is a, c, g, or t
  misc_feature (86)..(86): n is a, c, g, or t
agctgcaactcagtgagcgagctgtaactcagtgtgcagagctgccccggagctcggcggccgccgcgacangtctgaaggagaangctcgcggagctcaggagctccctggacaccggaagcagcctctccactgaccgctacagcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccgggaagcgagggcgtcgcagcagtgcgggatcgctagagagcaatgtggaatttcagcctttcgagccactgcagccgtcagtgctgtgctcctaagccatgggacccgaggactgccccccggcgcctgcccaggcggaggccctttcagaaagggcgaagctcacgcctgactctgcgggccgcggggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctttgtctcgcaattttgaggaggttgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattattgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgca

SEQ ID NO: 305316 - DNA, 4408 bp, Homo sapiens
gagaagccagccaggctgcggctgtttgtggcaggaggcccccacccacagcactggaccaagcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccgggaagcgagggcgtcgcagcagtgcgggatcgctagagagcaatgtggaatttcagcctttcgagccactgcagccgtcagtgctgtgctcctaagccatgggacccgaggactgccccccggcgcctgcccaggcggaggccctttcagaaagggcgaagctcacgcctgactctgcgggccgcggggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctttgtctcgcaattttgaggaggttgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattattgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgca

SEQ ID NO: 305317 - DNA, 4441 bp, Homo sapiens
  misc_feature (72)..(72): n is a, c, g, or t
  misc_feature (86)..(86): n is a, c, g, or t
agctgcaactcagtgagcgagctgtaactcagtgtgcagagctgccccggagctcggcggccgccgcgacangtctgaaggagaangctcgcggagcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccgggaagcgagggcgtcgcagcagtgcgggatcgctagagagcaatgtggaatttcagcctttcgagccactgcagccgtcagtgctgtgctcctaagccatgggacccgaggactgccccccggcgcctgcccaggcggaggccctttcagaaagggcgaagctcacgcctgactctgcgggccgcggggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctttgtctcgcaattttgaggaggttgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattattgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgca

SEQ ID NO: 305318 - DNA, 6458 bp, Homo sapiens
gcggccgccatgtggtgcctgcactgcaactcggagaggacccagtcccttctggagctagagcttgacagcggcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccggggtccatcattagcagtcctcacatgcgccggagagctacatcaacacgagagtgtccatctcgcccacaccagactatgcccaactcatcttccctcctgggctccttattcgggagcaagagagggaagccccctccccaggcccacctgccctcagccccagccctggccacccccccacccaccggtggtcctgcctcacttgcagcactctgtggctggccaccacctggggcccccagaggggctgccgcaggccgccatgcacgggcatcacacccagtactgccacatgcagaaccctcccccgtaccaccatcaccaccaccaccacccaccccagcacatccagcacgcacaccagtaccaccacggcccccatgggggccacccagcctacggggcccatgcccacggccacccgccgctgccctcggcccacgtggggcacacagtgcaccaccatgggcagccccctgccccgccgccccccaccagcagcaaggccaaacccagcggcatcagcacaattgtgtagacagcctgggtaggggtcccaggctccctgaaacacctgcacaccacacagggcacgcccgggggtcgccagccgcacaccaaacccggggcacttctgttgccatctctcccctctgcccctcacggcccaaccggagccccaggagcccacagggctggtgttgtgtggaacaaaggcccagatttcatttcttgttggcaccctgggctctgctcacctcagtctgagggatgggtgggcctcagacaccatcagccttgaaacggtgagccagccaagtagtgttgaactgcctcccccactccagctctcagctccctgtgccctaatgtacatgcatatgaaaacccaacctagaaaacgaagaaatgagatacaaaaacagacaaaacaaaccccaaaacttgctgcattattgctcttttattgacaatgggcaaaaaaataagtagacctgatatggttgatgaaaatacgtaagtaaactttatataaatatataaatatataaatatatatatatatatactgtataggtagtacttgtgtgtgaaaggcaggcgtttcagtccacattagcaatacccaccttacaaggagctccacttacctaataggaagacagtaccttagctgggtgtgtgagacaatagaccaaaccctaaatgctaggaacaaattcagatacttcatattttcatacaaagaagtccctctaggactggctaaaatctttacacaatcattactaactgtgccaagtaacatagcatctaactgtttaaaaagtccagtattgctttgtataaatccttattttattaacagaatactatcataaatagtattataatgctgttatttcaggtaagcaaatagctaaactgcagtacactctacagtagcaactcaggacagctggttacaagctggttgtcttaggacattggttacacggattcttagacactttaatggctgcgataactgtgactctccatgatccatgtttcttttatgcgcatatgatttgacgcacactcattcagagtcctccgagaggggcacccatacacggcagaagtgttcatctccaacatgaaagtgaccagctctcatcctcgtctccccaacaccataacgtcctcatcccgcctccaacccacaccaggccgaagccctcagagagtgttttcatcaggaaccactctcgaacctgaaggttgactttagcgtttagcaacccagggcggtgtgtgtgtttcccgttttgttttctgagtggtagcagtgatcaccgtaattccatgtagccatgtgctagcagaacccctgtgtcctcaccgtggcccgtgtgaccccagccgacgagtgcccggcggagcccccgctgccttcccatggtccagtgagctgccagggcatcacatgactctcagctgtgctcttgtcgcttctgtgttgtggtgacaccatgcgctccccagggccagacctgcacgcggcaggtctgtgcccgagtcacccacgggccatactttgtagtttcagcctttcgagccactgcagccgtcagtgctgtgctcctaagccatgggacccgaggactgccccccggcgcctgcccaggcggaggccctttcagaaagggcgaagctcacgcctgactctgcgggccgcggggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctttgtctcgcaattttgaggaggttgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattattgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgca

SEQ ID NO: 305319 - DNA, 2443 bp, Homo sapiens
ttgtaaggtgggtattgctaatgtggactgaaacgcctgcctttcacacacaagtactacctatacagtatatatatatatatatttatatatttatatatttatataaagtttacttacgtattttcatcaaccatatcaggtctacttattttattaacagaatactatcataaatagtattataatgctgttatttcaggtaagcaaatagctaaactgcagtacactctacagtagcaactcaggacagctggttacaagctggttgtcttaggacattggttacacggattcttagacactttaatggctgcgataactgtgactctccatgatccatgtttcttttatgcgcatatgatttgacgcacactcattcagagtcctccgagaggggcacccatacacggcagaagtgttcatctccaacatgaaagtgaccagctctcatcctcgtctccccaacaccataacgtcctcatcccgcctccaacccacaccaggccgaagccctcagagagtgttttcatcaggaaccactctcgaacctgaaggttgactttagcgtttagcaacccagggcggtgtgtgtgtttcccgttttgttttctgagtggtagcagtgatcaccgtaattccatgtagccatgtgctagcagaacccctgtgtcctcaccgtggcccgtgtgaccccagccgacgagtgcccggcggagcccccgctgccttcccatggtccagtgagctgccagggcatcacatgactctcagctgtgctcttgtcgcttctgtgttgtggtgacaccatgcgctccccagggccagacctgcacgcggcaggtctgtgcccgagtcacccacgggccatactttgtagtttcagcctttcgagccactgcagccgtcagtgctgtgctcctaagccatgggacccgaggactgccccccggcgcctgcccaggcggaggccctttcagaaagggcgaagctcacgcctgactctgcgggccgcggggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctttgtctcgcaattttgaggaggttgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattattgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgca

SEQ ID NO: 305320 - DNA, 7110 bp, Homo sapiens
gcggccgccatgtggtgcctgcactgcaactcggagaggacccagtcccttctggagctagagcttgacagcggcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccggggtccatcattagcagtcctcacatgcgccggagagctacatcaacacgagagtgtccatctcgcccacaccagactatgcccaactcatcttccctcctgggctccttattcgggagcaagagagggaagccccctccccaggcccacctgccctcagccccagccctggccacccccccacccaccggtggtcctgcctcacttgcagcactctgtggctggccaccacctggggcccccagaggggctgccgcaggccgccatgcacgggcatcacacccagtactgccacatgcagaaccctcccccgtaccaccatcaccaccaccaccacccaccccagcacatccagcacgcacaccagtaccaccacggcccccatgggggccacccagcctacggggcccatgcccacggccacccgccgctgccctcggcccacgtggggcacacagtgcaccaccatgggcagccccctgccccgccgccccccaccagcagcaaggccaaacccagcggcatcagcacaattgtgtagacagcctgggtaggggtcccaggctccctgaaacacctgcacaccacacagggcacgcccgggggtcgccagccgcacaccaaacccggggcacttctgttgccatctctcccctctgcccctcacggcccaaccggagccccaggagcccacagggctggtgttgtgtggaacaaaggcccagatttcatttcttgttggcaccctgggctctgctcacctcagtctgagggatgggtgggcctcagacaccatcagccttgaaacggtgagccagccaagtagtgttgaactgcctcccccactccagctctcagctccctgtgccctaatgtacatgcatatgaaaacccaacctagaaaacgaagaaatgagatacaaaaacagacaaaacaaaccccaaaacttgctgcattattgctcttttattgacaatgggcaaaaaaataagtagacctgatatggttgatgaaaatacgtaagtaaactttatataaatatataaatatataaatatatatatatatatactgtataggtagtacttgtgtgtgaaaggcaggcgtttcagtccacattagcaatacccaccttacaaggagctccacttacctaataggaagacagtaccttagctgggtgtgtgagacaatagaccaaaccctaaatgctaggaacaaattcagatacttcatattttcatacaaagaagtccctctaggactggctaaaatctttacacaatcattactaactgtgccaagtaacatagcatctaactgtttaaaaagtccagtattgctttgtataaatccttattttattaacagaatactatcataaatagtattataatgctgttatttcaggtaagcaaatagctaaactgcagtacactctacagtagcaactcaggacagctggttacaagctggttgtcttaggacattggttacacggattcttagacactttaatggctgcgataactgtgactctccatgatccatgtttcttttatgcgcatatgatttgacgcacactcattcagagtcctccgagaggggcacccatacacggcagaagtgttcatctccaacatgaaagtgaccagctctcatcctcgtctccccaacaccataacgtcctcatcccgcctccaacccacaccaggccgaagccctcagagagtgttttcatcaggaaccactctcgaacctgaaggttgactttagcgtttagcaacccagggcggtgtgtgtgtttcccgttttgttttctgagtggtagcagtgatcaccgtaattccatgtagccatgtgctagcagaacccctgtgtcctcaccgtggcccgtgtgaccccagccgacgagtgcccggcggagcccccgctgccttcccatggtccagtgagctgccagggcatcacatgactctcagctgtgctcttgtcgcttctgtgttgtggtgacaccatgcgctccccagggccagacctgcacgcggcaggtctgtgcccgagtcacccacgggccatactttgtagtttcagcctttcgagccactgcagccgtcagtgctgtgctcctaagccatgggacccgaggactgccccccggcgcctgcccaggcggaggccctttcagaaagggcgaagctcacgcctgactctgcgggccgcggggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctttgtctcgcaattttgaggaggttgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattattgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgcacatcttgcttaaaaatgtcttcagcacccagtgcagtgatctttccctcacacactgcatgcagcaggagcctcttgtttttcttaatgagctgaaaagacagcagatgttcacagctgatgctgggtgttgactcagcgccacgggaagctctgtgcccgcaggtaagcacgcacagtcttacagttctccttgtaaaatatcatcacccttcctgcctgagaaacgagtacatttgtattttatgtaacaacaatagtcaaggcagcattgcaacactgagcagggtgaggtgggggtgctgagcacaggacaagagggaggaggcctgccctccattcagatgcatctgcatcgcccttctgtgtgcagtcacatcgagactgcacacagcatgcatctcctcttggaaaatatcttttgcctccgagttgttttaagcaattagaatcaggtcctgaatccccagactgttcagagacttcaagggacacctccctcacaagaagcctggcacccccactgtgtacctttgagaggaaaggagtgcgtttgttttcatctgcattctgtttgtcagtggcaacagactctatcaatgtaaaaccatggttgtgatcatgtggggaaatcaaataaatcctttgaaact

SEQ ID NO: 305321 - DNA, 7800 bp, Homo sapiens
gcggccgccatgtggtgcctgcactgcaactcggagaggacccagtcccttctggagctagagcttgacagcggcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccggggtccatcattagcagtcctcacatgcgccggagagctacatcaacacgagagtgtccatctcgcccacaccagactatgcccaactcatcttccctcctgggctccttattcgggagcaagagagggaagccccctccccaggcccacctgccctcagccccagccctggccacccccccacccaccggtggtcctgcctcacttgcagcactctgtggctggccaccacctggggcccccagaggggctgccgcaggccgccatgcacgggcatcacacccagtactgccacatgcagaaccctcccccgtaccaccatcaccaccaccaccacccaccccagcacatccagcacgcacaccagtaccaccacggcccccatgggggccacccagcctacggggcccatgcccacggccacccgccgctgccctcggcccacgtggggcacacagtgcaccaccatgggcagccccctgccccgccgccccccaccagcagcaaggccaaacccagcggcatcagcacaattgtgtagacagcctgggtaggggtcccaggctccctgaaacacctgcacaccacacagggcacgcccgggggtcgccagccgcacaccaaacccggggcacttctgttgccatctctcccctctgcccctcacggcccaaccggagccccaggagcccacagggctggtgttgtgtggaacaaaggcccagatttcatttcttgttggcaccctgggctctgctcacctcagtctgagggatgggtgggcctcagacaccatcagccttgaaacggtgagccagccaagtagtgttgaactgcctcccccactccagctctcagctccctgtgccctaatgtacatgcatatgaaaacccaacctagaaaacgaagaaatgagatacaaaaacagacaaaacaaaccccaaaacttgctgcattattgctcttttattgacaatgggcaaaaaaataagtagacctgatatggttgatgaaaatacgtaagtaaactttatataaatatataaatatataaatatatatatatatatactgtataggtagtacttgtgtgtgaaaggcaggcgtttcagtccacattagcaatacccaccttacaaggagctccacttacctaataggaagacagtaccttagctgggtgtgtgagacaatagaccaaaccctaaatgctaggaacaaattcagatacttcatattttcatacaaagaagtccctctaggactggctaaaatctttacacaatcattactaactgtgccaagtaacatagcatctaactgtttaaaaagtccagtattgctttgtataaatccttattttattaacagaatactatcataaatagtattataatgctgttatttcaggtaagcaaatagctaaactgcagtacactctacagtagcaactcaggacagctggttacaagctggttgtcttaggacattggttacacggattcttagacactttaatggctgcgataactgtgactctccatgatccatgtttcttttatgcgcatatgatttgacgcacactcattcagagtcctccgagaggggcacccatacacggcagaagtgttcatctccaacatgaaagtgaccagctctcatcctcgtctccccaacaccataacgtcctcatcccgcctccaacccacaccaggccgaagccctcagagagtgttttcatcaggaaccactctcgaacctgaaggttgactttagcgtttagcaacccagggcggtgtgtgtgtttcccgttttgttttctgagtggtagcagtgatcaccgtaattccatgtagccatgtgctagcagaacccctgtgtcctcaccgtggcccgtgtgaccccagccgacgagtgcccggcggagcccccgctgccttcccatggtccagtgagctgccagggcatcacatgactctcagctgtgctcttgtcgcttctgtgttgtggtgacaccatgcgctccccagggccagacctgcacgcggcaggtctgtgcccgagtcacccacgggccatactttgtagtttcagcctttcgagccactgcagccgtcagtgctgtgctcctaagccatgggacccgaggactgccccccggcgcctgcccaggcggaggccctttcagaaagggcgaagctcacgcctgactctgcgggccgcggggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctttgtctcgcaattttgaggaggttgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattattgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgcacatcttgcttaaaaatgtcttcagcacccagtgcagtgatctttccctcacacactgcatgcagcaggagcctcttgtttttcttaatgagctgaaaagacagcagatgttcacagctgatgctgggtgttgactcagcgccacgggaagctctgtgcccgcaggtaagcacgcacagtcttacagttctccttgtaaaatatcatcacccttcctgcctgagaaacgagtacatttgtattttatgtaacaacaatagtcaaggcagcattgcaacactgagcagggtgaggtgggggtgctgagcacaggacaagagggaggaggcctgccctccattcagatgcatctgcatcgcccttctgtgtgcagtcacatcgagactgcacacagcatgcatctcctcttggaaaatatcttttgcctccgagttgttttaagcaattagaatcaggtcctgaatccccagactgttcagagacttcaagggacacctccctcacaagaagcctggcacccccactgtgtacctttgagaggaaaggagtgcgtttgttttcatctgcattctgtttgtcagtggcaacagactctatcaatgtaaaaccatggttgtgatcatgtggggaaatcaaataaatcctttgaaactctcggattctcactttttctgaaaagtccagaagttgccctgttggccagacccagatctccagctgatgagtttccccattacttgttgtgactctgggcactcactttccttgaagacattggactgactgaggacactgatacaaaatttaaaataaagggacacatcacaaccaataatacataacgaactaacgatcacgacctaatcacagcagtcctactactcctatctctcccagatccctaagctgatggcaatcaagtaataagtacataacaagaacgaaaacataaacacaacatagagtgtggaccccagccagaacaaatgcaagcggccaatcaaataaacaaaaagctatcctgaattatcaaggaaaacgccatgaacaaaaaaagcggaatccaaacacggaacacgcgcagaagccgcccataaagcacaagacaatgagccaacgcacaacaacgcgagaacacttctcggaaagagcaagagaacacgaaccgtagacgagagacaacgatcaataagggaccacaaaccaaaacaatagaaagaaaaaacaacgacaggagctgaatccaacaccaactaatacgacgactaacgggacagacacgcaaatatcgggacgagagaaatagactcacacagagacatctaaaaatacgagacaggacg

SEQ ID NO: 305322 - DNA, 7056 bp, Homo sapiens
gcggccgccatgtggtgcctgcactgcaactcggagaggacccagtcccttctggagctagagcttgacagcggcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccggggtccatcattagcagtcctcacatgcgccggagagctacatcaacacgagagtgtccatctcgcccacaccagactatgcccaactcatcttccctcctgggctccttattcgggagcaagagagggaagccccctccccaggcccacctgccctcagccccagccctggccacccccccacccaccggtggtcctgcctcacttgcagcactctgtggctggccaccacctggggcccccagaggggctgccgcaggccgccatgcacgggcatcacacccagtactgccacatgcagaaccctcccccgtaccaccatcaccaccaccaccacccaccccagcacatccagcacgcacaccagtaccaccacggcccccatgggggccacccagcctacggggcccatgcccacggccacccgccgctgccctcggcccacgtggggcacacagtgcaccaccatgggcagccccctgccccgccgccccccaccagcagcaaggccaaacccagcggcatcagcacaattgtgtagacagcctgggtaggggtcccaggctccctgaaacacctgcacaccacacagggcacgcccgggggtcgccagccgcacaccaaacccggggcacttctgttgccatctctcccctctgcccctcacggcccaaccggagccccaggagcccacagggctggtgttgtgtggaacaaaggcccagatttcatttcttgttggcaccctgggctctgctcacctcagtctgagggatgggtgggcctcagacaccatcagccttgaaacggtgagccagccaagtagtgttgaactgcctcccccactccagctctcagctccctgtgccctaatgtacatgcatatgaaaacccaacctagaaaacgaagaaatgagatacaaaaacagacaaaacaaaccccaaaacttgctgcattattgctcttttattgacaatgggcaaaaaaataagtagacctgatatggttgatgaaaatacgtaagtaaactttatataaatatataaatatataaatatatatatatatatactgtataggtagtacttgtgtgtgaaaggcaggcgtttcagtccacattagcaatacccaccttacaaggagctccacttacctaataggaagacagtaccttagctgggtgtgtgagacaatagaccaaaccctaaatgctaggaacaaattcagatacttcatattttcatacaaagaagtccctctaggactggctaaaatctttacacaatcattactaactgtgccaagtaacatagcatctaactgtttaaaaagtccagtattgctttgtataaatccttattttattaacagaatactatcataaatagtattataatgctgttatttcaggtaagcaaatagctaaactgcagtacactctacagtagcaactcaggacagctggttacaagctggttgtcttaggacattggttacacggattcttagacactttaatggctgcgataactgtgactctccatgatccatgtttcttttatgcgcatatgatttgacgcacactcattcagagtcctccgagaggggcacccatacacggcagaagtgttcatctccaacatgaaagtgaccagctctcatcctcgtctccccaacaccataacgtcctcatcccgcctccaacccacaccaggccgaagccctcagagagtgttttcatcaggaaccactctcgaacctgaaggttgactttagcgtttagcaacccagggcggtgtgtgtgtttcccgttttgttttctgagtggtagcagtgatcaccgtaattccatgtagccatgtgctagcagaacccctgtgtcctcaccgtggcccgtgtgaccccagccgacgagtgcccggcggagcccccgctgccttcccatggtccagtgagctgccagggcatcacatgactctcagctgtgctcttgtcgcttctgtgttgtggtgacaccatgcgctccccagggccagacctgcacgcggcaggtctgtgcccgagtcacccacgggccatactttgtagtttcagcctttcgagccactgcagccgtcagtgctgtgctcctaagccatgggacccgaggactgccccccggcgcctgcccaggcggaggccctttcagaaagggcgaagctcacgcctgactctgcgggccgcggggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctttgtctcgcaattttgaggaggttgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattattgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgcacatcttgcttaaaaatgtcttcagcacccagtgcagtgatctttccctcacacactgcatgcagcaggagcctcttgtttttcttaatgagctgaactctgtgcccgcaggtaagcacgcacagtcttacagttctccttgtaaaatatcatcacccttcctgcctgagaaacgagtacatttgtattttatgtaacaacaatagtcaaggcagcattgcaacactgagcagggtgaggtgggggtgctgagcacaggacaagagggaggaggcctgccctccattcagatgcatctgcatcgcccttctgtgtgcagtcacatcgagactgcacacagcatgcatctcctcttggaaaatatcttttgcctccgagttgttttaagcaattagaatcaggtcctgaatccccagactgttcagagacttcaagggacacctccctcacaagaagcctggcacccccactgtgtacctttgagaggaaaggagtgcgtttgttttcatctgcattctgtttgtcagtggcaacagactctatcaatgtaaaaccatggttgtgatcatgtggggaaatcaaataaatcctttgaaact

SEQ ID NO: 305323 - DNA, 7746 bp, Homo sapiens
gcggccgccatgtggtgcctgcactgcaactcggagaggacccagtcccttctggagctagagcttgacagcggcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccggggtccatcattagcagtcctcacatgcgccggagagctacatcaacacgagagtgtccatctcgcccacaccagactatgcccaactcatcttccctcctgggctccttattcgggagcaagagagggaagccccctccccaggcccacctgccctcagccccagccctggccacccccccacccaccggtggtcctgcctcacttgcagcactctgtggctggccaccacctggggcccccagaggggctgccgcaggccgccatgcacgggcatcacacccagtactgccacatgcagaaccctcccccgtaccaccatcaccaccaccaccacccaccccagcacatccagcacgcacaccagtaccaccacggcccccatgggggccacccagcctacggggcccatgcccacggccacccgccgctgccctcggcccacgtggggcacacagtgcaccaccatgggcagccccctgccccgccgccccccaccagcagcaaggccaaacccagcggcatcagcacaattgtgtagacagcctgggtaggggtcccaggctccctgaaacacctgcacaccacacagggcacgcccgggggtcgccagccgcacaccaaacccggggcacttctgttgccatctctcccctctgcccctcacggcccaaccggagccccaggagcccacagggctggtgttgtgtggaacaaaggcccagatttcatttcttgttggcaccctgggctctgctcacctcagtctgagggatgggtgggcctcagacaccatcagccttgaaacggtgagccagccaagtagtgttgaactgcctcccccactccagctctcagctccctgtgccctaatgtacatgcatatgaaaacccaacctagaaaacgaagaaatgagatacaaaaacagacaaaacaaaccccaaaacttgctgcattattgctcttttattgacaatgggcaaaaaaataagtagacctgatatggttgatgaaaatacgtaagtaaactttatataaatatataaatatataaatatatatatatatatactgtataggtagtacttgtgtgtgaaaggcaggcgtttcagtccacattagcaatacccaccttacaaggagctccacttacctaataggaagacagtaccttagctgggtgtgtgagacaatagaccaaaccctaaatgctaggaacaaattcagatacttcatattttcatacaaagaagtccctctaggactggctaaaatctttacacaatcattactaactgtgccaagtaacatagcatctaactgtttaaaaagtccagtattgctttgtataaatccttattttattaacagaatactatcataaatagtattataatgctgttatttcaggtaagcaaatagctaaactgcagtacactctacagtagcaactcaggacagctggttacaagctggttgtcttaggacattggttacacggattcttagacactttaatggctgcgataactgtgactctccatgatccatgtttcttttatgcgcatatgatttgacgcacactcattcagagtcctccgagaggggcacccatacacggcagaagtgttcatctccaacatgaaagtgaccagctctcatcctcgtctccccaacaccataacgtcctcatcccgcctccaacccacaccaggccgaagccctcagagagtgttttcatcaggaaccactctcgaacctgaaggttgactttagcgtttagcaacccagggcggtgtgtgtgtttcccgttttgttttctgagtggtagcagtgatcaccgtaattccatgtagccatgtgctagcagaacccctgtgtcctcaccgtggcccgtgtgaccccagccgacgagtgcccggcggagcccccgctgccttcccatggtccagtgagctgccagggcatcacatgactctcagctgtgctcttgtcgcttctgtgttgtggtgacaccatgcgctccccagggccagacctgcacgcggcaggtctgtgcccgagtcacccacgggccatactttgtagtttcagcctttcgagccactgcagccgtcagtgctgtgctcctaagccatgggacccgaggactgccccccggcgcctgcccaggcggaggccctttcagaaagggcgaagctcacgcctgactctgcgggccgcggggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctttgtctcgcaattttgaggaggttgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattattgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgcacatcttgcttaaaaatgtcttcagcacccagtgcagtgatctttccctcacacactgcatgcagcaggagcctcttgtttttcttaatgagctgaactctgtgcccgcaggtaagcacgcacagtcttacagttctccttgtaaaatatcatcacccttcctgcctgagaaacgagtacatttgtattttatgtaacaacaatagtcaaggcagcattgcaacactgagcagggtgaggtgggggtgctgagcacaggacaagagggaggaggcctgccctccattcagatgcatctgcatcgcccttctgtgtgcagtcacatcgagactgcacacagcatgcatctcctcttggaaaatatcttttgcctccgagttgttttaagcaattagaatcaggtcctgaatccccagactgttcagagacttcaagggacacctccctcacaagaagcctggcacccccactgtgtacctttgagaggaaaggagtgcgtttgttttcatctgcattctgtttgtcagtggcaacagactctatcaatgtaaaaccatggttgtgatcatgtggggaaatcaaataaatcctttgaaactctcggattctcactttttctgaaaagtccagaagttgccctgttggccagacccagatctccagctgatgagtttccccattacttgttgtgactctgggcactcactttccttgaagacattggactgactgaggacactgatacaaaatttaaaataaagggacacatcacaaccaataatacataacgaactaacgatcacgacctaatcacagcagtcctactactcctatctctcccagatccctaagctgatggcaatcaagtaataagtacataacaagaacgaaaacataaacacaacatagagtgtggaccccagccagaacaaatgcaagcggccaatcaaataaacaaaaagctatcctgaattatcaaggaaaacgccatgaacaaaaaaagcggaatccaaacacggaacacgcgcagaagccgcccataaagcacaagacaatgagccaacgcacaacaacgcgagaacacttctcggaaagagcaagagaacacgaaccgtagacgagagacaacgatcaataagggaccacaaaccaaaacaatagaaagaaaaaacaacgacaggagctgaatccaacaccaactaatacgacgactaacgggacagacacgcaaatatcgggacgagagaaatagactcacacagagacatctaaaaatacgagacaggacg

SEQ ID NO: 305324 - DNA, 1344 bp, Homo sapiens
  misc_feature (44)..(44): n is a, c, g, or t
  misc_feature (54)..(54): n is a, c, g, or t
cggagacctcttgcgcggtcctgttcttgcctggtgtcggtggntagtttctgngcctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctttgtctcgcaattttgaggaggttgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattattgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgca

SEQ ID NO: 305325 - DNA, 1298 bp, Homo sapiens
gttttatttgcaagcttatcaaacagaatgaaacctcactagcctgaaggaacacactgagtgcggcgggaaaccccgggaagggctcagtgggttccagcagttccttacgcgaggccctgctgcccagcacagctccagttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattattgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgcacatcttgcttaaaaatgtcttcagcacccagtgcagtgatctttccctcacacactgcatgcagcaggagcctcttgtttttcttaatgagctgaaaagacagcagatgttcacagctgatgctgggtgttgactcagcgccacgggaagctctgtgcccgcaggtaagcacgcacagtcttacagttctccttgtaaaatatcatcacccttcctgcctgagaaacgagtacatttgtattttatgtaacaacaatagtcaaggcagcattgcaacactgagcagggtgaggtgggggtgctgagcacaggacaagagggaggaggcctgccctccattcagatgcatctgcatcgcccttctgtgtgcagtcacatcgagactgcacacagcatgcatctcctcttggaaaatatcttttgcctccgagttgttttaagcaattagaatcaggtcctgaatccccagactgttcagagacttcaagggacacctccctcacaagaagcctggcacccccactgtgtacctttgagaggaaaggagtgcgtttgttttcatctgcattctgtttgtcagtggcaacagactctatcaatgtaaaaccatggttgtgatcatgtggggaaatcaaataaatcctttgaaact

SEQ ID NO: 305326 - DNA, 1253 bp, Homo sapiens
ccccgactagcccgacgaggcagagtcgggccaggaggcaggagcttcttcctaggcaggcacacccgggctcctcactcagcccacagcacggacttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattattgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgcacatcttgcttaaaaatgtcttcagcacccagtgcagtgatctttccctcacacactgcatgcagcaggagcctcttgtttttcttaatgagctgaaaagacagcagatgttcacagctgatgctgggtgttgactcagcgccacgggaagctctgtgcccgcaggtaagcacgcacagtcttacagttctccttgtaaaatatcatcacccttcctgcctgagaaacgagtacatttgtattttatgtaacaacaatagtcaaggcagcattgcaacactgagcagggtgaggtgggggtgctgagcacaggacaagagggaggaggcctgccctccattcagatgcatctgcatcgcccttctgtgtgcagtcacatcgagactgcacacagcatgcatctcctcttggaaaatatcttttgcctccgagttgttttaagcaattagaatcaggtcctgaatccccagactgttcagagacttcaagggacacctccctcacaagaagcctggcacccccactgtgtacctttgagaggaaaggagtgcgtttgttttcatctgcattctgtttgtcagtggcaacagactctatcaatgtaaaaccatggttgtgatcatgtggggaaatcaaataaatcctttgaaact

SEQ ID NO: 305327 - DNA, 5621 bp, Homo sapiens
gcggccgccatgtggtgcctgcactgcaactcggagaggacccagtcccttctggagctagagcttgacagcggcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccggggtccatcattagcagtcctcacatgcgccggagagctacatcaacacgagagtgtccatctcgcccacaccagactatgcccaactcatcttccctcctgggctccttattcgggagcaagagagggaagccccctccccaggcccacctgccctcagccccagccctggccacccccccacccaccggtggtcctgcctcacttgcagcactctgtggctggccaccacctggggcccccagaggggctgccgcaggccgccatgcacgggcatcacacccagtactgccacatgcagaaccctcccccgtaccaccatcaccaccaccaccacccaccccagcacatccagcacgcacaccagtaccaccacggcccccatgggggccacccagcctacggggcccatgcccacggccacccgccgctgccctcggcccacgtggggcacacagtgcaccaccatgggcagccccctgccccgccgccccccaccagcagcaaggccaaacccagcggcatcagcacaattgtgtagacagcctgggtaggggtcccaggctccctgaaacacctgcacaccacacagggcacgcccgggggtcgccagccgcacaccaaacccggggcacttctgttgccatctctcccctctgcccctcacggcccaaccggagccccaggagcccacagggctggtgttgtgtggaacaaaggcccagatttcatttcttgttggcaccctgggctctgctcacctcagtctgagggatgggtgggcctcagacaccatcagccttgaaacggtgagccagccaagtagtgttgaactgcctcccccactccagctctcagctccctgtgccctaatgtacatgcatatgaaaacccaacctagaaaacgaagaaatgagatacaaaaacagacaaaacaaaccccaaaacttgctgcattattgctcttttattgacaatgggcaaaaaaataagtagacctgatatggttgatgaaaatacgtaagtaaactttatataaatatataaatatataaatatatatatatatatactgtataggtagtacttgtgtgtgaaaggcaggcgtttcagtccacattagcaatacccaccttacaaggagctccacttacctaataggaagacagtaccttagctgggtgtgtgagacaatagaccaaaccctaaatgctaggaacaaattcagatacttcatattttcatacaaagaagtccctctaggactggctaaaatctttacacaatcattactaactgtgccaagtaacatagcatctaactgtttaaaaagtccagtattgctttgtataaatccttattttattaacagaatactatcataaatagtattataatgctgttatttcaggtaagcaaatagctaaactgcagtacactctacagtagcaactcaggacagctggttacaagctggttgtcttaggacattggttacacggattcttagacactttaatggctgcgataactgtgactctccatgatccatgtttcttttatgcgcatatgatttgacgcacactcattcagagtcctccgagaggggcacccatacacggcagaagtgttcatctccaacatgaaagtgaccagctctcatcctcgtctccccaacaccataacgtcctcatcccgcctccaacccacaccaggccgaagccctcagagagtgttttcatcaggaaccactctcgaacctgaaggttgactttagcgtttagcaacccagggcggtgtgtgtgtttcccgttttgttttctgagtggtagcagtgatcaccgtaattccatgtagccatgtgctagcagaacccctgtgtcctcaccgtggcccgtgtgaccccagccgacgagtgcccggcggagcccccgctgccttcccatggtccagtgagctgccagggcatcacatgactctcagctgtgctcttgtcgcttctgtgttgtggtgacaccatgcgctccccagggccagacctgcacgcggcaggtctgtgcccgagtcacccacgggccatactttgtagtttcagcctttcgagccactgcagccgtcagtgctgtgctcctaagccatgggacccgaggactgccccccggcgcctgcccaggcggaggccctttcagaaagggcgaagctcacgcctgactctgcgggccgcggggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctttgtctcgcaattttgaggaggttgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattg

SEQ ID NO: 305328 - DNA, 3777 bp, Homo sapiens
gcggccgccatgtggtgcctgcactgcaactcggagaggacccagtcccttctggagctagagcttgacagcggcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccggtaagagcttggcctagaaccaccttgctagcccagcgcatgcaagaccgaggcagggcgtctgcattcagggcatgcatcacgcggggcagggcctgcggcgaagccagtgcggcatttcccctgaccttccgcaaagcagagcagcgtgtgacatacagaaagggcgccccaaaaagacacagggaaacaggacccaaacgtcaaaaagaaaggcattgcacacgaattagctggggaagtcacccccattttccctttcttcttccaggggttttatttacttgtttattgatctgggaagtcgctctagcccgagtgagccggcggctgtgtcccgtgctctctgtgcggccgcgtccctgtgcttcatgctgatgaatgaacttgcgcggaaccctctaatctgtctggcgcccccttgcccactgtccccggtcttgctttccctgcggggcctcctctcctgggaaacccgggcctcgtccagcccagaggccattgagcagcagccagggctggctccggggtccgggaaagccctggtgggaactgtgatgttgtggttgtttctttgtttctgtgtgtgtttaatttgctgccagctgtttaacccccaagcaagcagcacccctgaaactgcctacattcctgggagtggggcaccgggagcagcaaggctcaggggcttttgccagcagctgtggcccaggctctcccttgtggggcaggagagaaaagaggcactggccgaccggtgggtgccggctcgtgccgctgcaggctgtgttgctgctcaaggagtgtacgggagggtatcatagccgccctccgccgaacagtctgtccaccagtcagcgagcttctcccaggaggggccccggggactgcctggggctgcagtggcccagcttgtcccacgcaggtctgccccaggagcctggtgtgcctgttttgggaagaccccccca

SEQ ID NO: 305329 - DNA, 2647 bp, Homo sapiens
gcggccgccatgtggtgcctgcactgcaactcggagaggacccagtcccttctggagctagagcttgacagcggcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtgtaagtctgcccccagggcctgcctggaagagcgcatgtcccagcttacgctctttctcctggctgcttcgaggacagaaccgcggggggcttcgacgctcacccctgttttatccccagagagcagattgcagctaggagctccggtgagctgtaggcacagaccctcaagaggcccat

SEQ ID NO: 305330 - DNA, 355 bp, Homo sapiens
gctcccaggtgaacgtgatagtttaagaagcctggtacctgcccaaaagaatggaaaggaggtctcagcagaagctggggcacgtccctagtccttcaggagagcagagatacgggattttaaatagtggctcctgagaacagagtacgggaaactgccatgagccaaaagacgtatctgctcttcaatgtctgtgagggaaggcattttttaactcaaggcccacgtgccgggtttctagcttgaagggctagacttctccactgcggcccccagggctcctagaggagagctgggcggccgtggcaggacagcctcttcccacacaggtgctctctctgccccaccgtcggtt

SEQ ID NO: 305331 - DNA, 208 bp, Homo sapiens
tattgtcttcatggtttagatagggaaactaaggcccagacaagcattacagctggcaagtagggacaccgcaaacggaggctaagcctgactccacagcccaggctttccccattcaggttagatccggggccaccagcagggaaaagggaggaaggaaagtgtcccggtgaatttggaacacagtatgaaacctcgtttgctaaat

SEQ ID NO: 305332 - DNA, 2503 bp, Homo sapiens
agtacagtataaaacttcacagtgccaataccatgaagaggagctcagacagctcttaccacatgatacaagagccggctggtggaagagtggggaccagaaagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagaaattaaaaacaaaacaaaacaaaaaaaaaaacaaaaaaaaacaaaagtaaattaaaaacaaaacctgatgaaacagatgaaggaagatgtggaaaaaatccttagccagggctcagagatgaagcagtgaaagagacaggaattgggagggaaagggagaatggtgtaccctttatttcttctgaaatcacactgatgacatcagttgtttaaacggggtattgtcctttccccccttgaggttcccttgtgagccttgaatcaaccaatctagtctgcagtagtgtggactagaacaacccaaatagcatctagaaagccatgagtttgaaagggcccatcacaggcactttcctacccaattacccaggtcataaggtatgtctgtgtgacacttatctctgtgtatatcagcatacacacacacacacacacacacacacacacacaggcatttccacacattacatatatacacatactggtaaaagaacaatcgtgtgcaggtggtcacacttcctttttctgtaccacttttgcaacaaaacaaaacaaacaacattaaaaaattgagaacaagtatggaaagaatgaaagatcaaggaaaaaagaataccaagttacatttcgttaaggtgcttatgatcttagaactatgcaacctaataggtttgaaactgtttacctgagagaggaacaaaaagagagacttttttgtattggaagtaatctgattaatttttattttcttcaaggagagatacttgaaaggaatatgtttgtccatctgttggatccaaacatttctatattttgtaaatgttgttgttgttttttttttaatcgtttactatttgcactacaatggtgtttga

SEQ ID NO: 305333 - DNA, 2658 bp, Homo sapiens
cctctctcttctctccccctctctcctctctctctgtctctgtctccctcccatcctctctctctgtctctgtctgtctccccgccaccctgtctctccctccctccctgtctccctccctccctccctccttccttctctcttactcggagacagtcagaactctcctccctgacagccacaaacctacagcactgactgcattcagagaggaacctgcaaacaaaacttcacagaaaactttttgttcttgttccagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagaaattaaaaacaaaacaaaacaaaaaaaaaaacaaaaaaaaacaaaagtaaattaaaaacaaaacctgatgaaacagatgaaggaagatgtggaaaaaatccttagccagggctcagagatgaagcagtgaaagagacaggaattgggagggaaagggagaatggtgtaccctttatttcttctgaaatcacactgatgacatcagttgtttaaacggggtattgtcctttccccccttgaggttcccttgtgagccttgaatcaaccaatctagtctgcagtagtgtggactagaacaacccaaatagcatctagaaagccatgagtttgaaagggcccatcacaggcactttcctacccaattacccaggtcataaggtatgtctgtgtgacacttatctctgtgtatatcagcatacacacacacacacacacacacacacacacacaggcatttccacacattacatatatacacatactggtaaaagaacaatcgtgtgcaggtggtcacacttcctttttctgtaccacttttgcaacaaaacaaaacaaacaacattaaaaaattgagaacaagtatggaaagaatgaaagatcaaggaaaaaagaataccaagttacatttcgttaaggtgcttatgatcttagaactatgcaacctaataggtttgaaactgtttacctgagagaggaacaaaaagagagacttttttgtattggaagtaatctgattaatttttattttcttcaaggagagatacttgaaaggaatatgtttgtccatctgttggatccaaacatttctatattttgtaaatgttgttgttgttttttttttaatcgtttactatttgcactacaatggtgtttga

SEQ ID NO: 305334 - DNA, 2474 bp, Homo sapiens
gatgatacaagagccggctggtggaagagtggggaccagaaagagaatttgctgaagaggagaaggaccagaaagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagaaattaaaaacaaaacaaaacaaaaaaaaaaacaaaaaaaaacaaaagtaaattaaaaacaaaacctgatgaaacagatgaaggaagatgtggaaaaaatccttagccagggctcagagatgaagcagtgaaagagacaggaattgggagggaaagggagaatggtgtaccctttatttcttctgaaatcacactgatgacatcagttgtttaaacggggtattgtcctttccccccttgaggttcccttgtgagccttgaatcaaccaatctagtctgcagtagtgtggactagaacaacccaaatagcatctagaaagccatgagtttgaaagggcccatcacaggcactttcctacccaattacccaggtcataaggtatgtctgtgtgacacttatctctgtgtatatcagcatacacacacacacacacacacacacacacacacaggcatttccacacattacatatatacacatactggtaaaagaacaatcgtgtgcaggtggtcacacttcctttttctgtaccacttttgcaacaaaacaaaacaaacaacattaaaaaattgagaacaagtatggaaagaatgaaagatcaaggaaaaaagaataccaagttacatttcgttaaggtgcttatgatcttagaactatgcaacctaataggtttgaaactgtttacctgagagaggaacaaaaagagagacttttttgtattggaagtaatctgattaatttttattttcttcaaggagagatacttgaaaggaatatgtttgtccatctgttggatccaaacatttctatattttgtaaatgttgttgttgttttttttttaatcgtttactatttgcactacaatggtgtttga

SEQ ID NO: 305335 - DNA, 2061 bp, Homo sapiens
ttaaaagtataaaagccattcttagtttgcaggcagtacagaaacagtttcagcccatgggctgtcatttgttgacccctattcaagagggtctgtcacagaagactcctgcttgcctgaaatttacgagtgcatgtaaatgttggaattaacaggtgtgcctgttttctcttatgctgtctttcatcttcaggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagaaattaaaaacaaaacaaaacaaaaaaaaaaacaaaaaaaaacaaaagtaaattaaaaacaaaacctgatgaaacagatgaaggaagatgtggaaaaaatccttagccagggctcagagatgaagcagtgaaagagacaggaattgggagggaaagggagaatggtgtaccctttatttcttctgaaatcacactgatgacatcagttgtttaaacggggtattgtcctttccccccttgaggttcccttgtgagccttgaatcaaccaatctagtctgcagtagtgtggactagaacaacccaaatagcatctagaaagccatgagtttgaaagggcccatcacaggcactttcctacccaattacccaggtcataaggtatgtctgtgtgacacttatctctgtgtatatcagcatacacacacacacacacacacacacacacacacaggcatttccacacattacatatatacacatactggtaaaagaacaatcgtgtgcaggtggtcacacttcctttttctgtaccacttttgcaacaaaacaaaacaaacaacattaaaaaattgagaacaagtatggaaagaatgaaagatcaaggaaaaaagaataccaagttacatttcgttaaggtgcttatgatcttagaactatgcaacctaataggtttgaaactgtttacctgagagaggaacaaaaagagagacttttttgtattggaagtaatctgattaatttttattttcttcaaggagagatacttgaaaggaatatgtttgtccatctgttggatccaaacatttctatattttgtaaatgttgttgttgttttttttttaatcgtttactatttgcactacaatggtgtttga

SEQ ID NO: 305336 - DNA, 625 bp, Homo sapiens
gatgatacaagagccggctggtggaagagtggggaccagaaagagaatttgctgaagaggagaaggaccagaaagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggttggtgctggcattggca

SEQ ID NO: 305337 - DNA, 861 bp, Homo sapiens
aagaagtaaggactgtttggaagaggccctgaaataactttctaggctattaaaaaattctatatcttaattggtatgttagttacatgaggtatatgttaaaacatgttagattgtacctttaacatctgtttactgtatttcactgtaatttttactttaataagatataagaacagtttttgagaacattctggggcacctaaatccaggggactgatgtattttatctgaaaaagaccgcctatgggcagcatccagagcggaccagctccctgtgctggaggactccagtgtgaggcctgctgcttcctttctacattggcctgaaaccagcccaactcagtggtcataatcttctgggcctaccgaagagcaaaagcctacttctagttcttccagttgccagttcaagggctttatctgtcacttcctttgggaacaggtagagtgctttgatttagaatgatggcaataaatgagaaaccaatttgaaattggatgtgagagtcttttgtcctttattgtgttgttcctgaacttgtagctaaggagggtagagtagagagagggatatataaccttatccaaggaaatagattagtaatacttcatccccaccacactttaatttgcacatatttctagagtataggacatcaaaaatacctagatattaaaatatttatgttgttaaccttcagctggtttagccgtatctattaaggatagaaaacaactgttcttcagttacttatcacatctgcttactaatttatgttatgtttatcatctcttcccatctaatagatgaaacaggcagataggtctggctcttccacttgctgacccagagttcac

SEQ ID NO: 305338 - DNA, 1439 bp, Homo sapiens
atctgtgcccggcggcgcaggacggcggtgggcggggctcacgcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagc

SEQ ID NO: 305339 - DNA, 1065 bp, Homo sapiens
  misc_feature (1064)..(1064): n is a, c, g, or t
atctgtgcccggcggcgcaggacggcggtgggcggggctcacgcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaatgtctccacatctctagagatcacgagctggctcaatcactagtgaatgtcgcgcnc

SEQ ID NO: 305340 - DNA, 659 bp, Homo sapiens
  misc_feature (546)..(546): n is a, c, g, or t
atctgtgcccggcggcgcaggacggcggtgggcggggctcacgcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtggggtngtctctcagtccatgggcaattttacgtgcttcccgcttcgagctcctcctctgcccccctctaccccgctctccgtcctttcctccctctcccccttcccttcctccggccc

SEQ ID NO: 305341 - DNA, 531 bp, Homo sapiens
gtgaaattgggctggatgaagagcaaagtgaagccagcacagatggggagaaagtcataggatctgtggacctcagtaagatcaatgatttgtagcagtggagatacttgagcaaataagatttaggaggtggtgatcagagagtgggctatcagaggtggttcagtctctgaatgtcatggttcaggttgtggccatgggagtggaaggctgaagtgaatagaggagagagaaaataacccagaataaggacacccagaaattatccccatttaatctcaattttctttcagagaggtcatgactttcatgaaggcgttagagctggtaagtggcaaatgggaacttaccattttggggaaatgggatttgtgagcatatgctgttaattaaagaagatacagattatgcatcccaaatcctaaaatccaaaatgtaccaaaatctgaaactatttgagcaccaacatgacactcaaatgttcattggaccataagtataatgcaaatattccaaaatctgaaaaaaaaa

SEQ ID NO: 305342 - DNA, 469 bp, Homo sapiens
aaaatagaatacatataaaaattttgcaggaaaaaagtatgatagaaaaatgtgcctagtataagaatttctgtcaattcagtaagtaaaatctagcaatattagacaaaaataatggtattaacatttgtatcttctcttgacagttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagc

SEQ ID NO: 305343 - DNA, 756 bp, Homo sapiens
ctcggctgcaaaccccactagccagtgtcagcctctcggcgggagtgaggcggcggcggaggaggagcagggggagggctgtcaaattcgggagccagattttttcccttctcctggcaatcccttccgcttccccggctcccggcgtgacatctgcgggccggggacctgcatgtgtgtgcgcgcgaaggagcggaagaatggcagtgctcaaactcaccgaccagcataatgcagtgaagatgggtgaagagagatgtgtttcatctgaaatttgaagggctttacaactcttctcctttaactaacttaccatcctttaactaacttaccacccaaaatgaattctgtagcctttgtcacctgtcttttctgcttctacatttttgcagttacccatgtaaattcttagctggctctggggtcagactgtctggatttaaatcctatttctaccacttatctgggtgtagaccttggagaaactgtatcactactctgtgcctcagtttcctcatctgagaaatagagataataatggcctctagctagtgagaattaaatgagagaatgcacataaggtgtatagtaaggtgcctggtactagatgtgctcaacaatataaactattattcctcacctacatttgggaggcactcttaactgcccatcacactttcttccttgctaacagaccacagttttattcaggcattcagctgcggtgtggccagcctcgggatgaatgaatgaagg

SEQ ID NO: 305344 - DNA, 338 bp, Homo sapiens
atctgtgcccggcggcgcaggacggcggtgggcggggctcacgcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctatatggcgtgaacccgggaggcggagcttgcagtgagccgagatcgcgccactgcactccagcctgggcgacagagcgagactccgtctcaaaaaaaaaaaaaaaaaaaaaaagaaa

SEQ ID NO: 305345 - DNA, 1740 bp, Homo sapiens
atctgtgcccggcggcgcaggacggcggtgggcggggctcacgcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagctatactcatctgtttatatattatctgtggctgctttgaaatgagtagttgcaatagagatggtaaagcctacaaagcctaattatttactgtctggtttttgtcagaaaaaagtttgtcaatccttgttttagaagatggaaaaatgtgaagatctttggagattctcttgagtggtatatctaattgaaatgggatcttcgtttggcttgtatgttgatgaaatcaacttaggtatacaatataaaaaataaagaccctgaaaat

SEQ ID NO: 305346 - DNA, 1974 bp, Homo sapiens
atctgtgcccggcggcgcaggacggcggtgggcggggctcacgcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagctatactcatctgtttatatattatctgtggctgctttgaaatgagtagttgcaatagagatggtaaagcctacaaagcctaattatttactgtctggtttttgtcagaaaaaagtttgtcaatccttgttttagaagatggaaaaatgtgaagatctttggagattctcttgagtggtatatctaattgaaatgggatcttcgtttggcttgtatgttgatgaaatcaacttaggtatacaatataaaaaataaagaccctgaaaatgttttggatactgtgttaatgcctcatagaatttttgttttggatactgtgttaatgcctcatagaattttctccatatatgagtgtgttttaaagtaactgagttactgtagcagaagagctccttttataaacattagaaaccttgggcagagagaaaagatttttattaacgtccctcttcagtattaactcagacttggtcttccctaaaataatcagaataccatccca

SEQ ID NO: 305347 - DNA, 1473 bp, Homo sapiens
atctgtgcccggcggcgcaggacggcggtgggcggggctcacgcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagc

SEQ ID NO: 305348 - DNA, 1706 bp, Homo sapiens
atctgtgcccggcggcgcaggacggcggtgggcggggctcacgcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagctatactcatctgtttatatattatctgtggctgctttgaaatgagtagttgcaatagagatggtaaagcctacaaagcctaattatttactgtctggtttttgtcagaaaaaagtttgtcaatccttgttttagaagatggaaaaatgtgaagatctttggagattctcttgagtggtatatctaattgaaatgggatcttcgtttggcttgtatgttgatgaaatcaacttaggtatacaatataaaaaataaagaccctgaaaat

SEQ ID NO: 305349 - DNA, 1677 bp, Homo sapiens
atctgtgcccggcggcgcaggacggcggtgggcggggctcacgcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttgaggtgacaggcttttaagaaaaaagtttgtcaatccttgttttagaagatggaaaaatgtgaagatctttggagattctcttgagtggtatatctaattgaaatgggatcttcgtttggcttgtatgttgatgaaatcaacttaggtatacaatataaaaaataaagaccctgaaaatgttttggatactgtgttaatgcctcatagaatttttgttttggatactgtgttaatgcctcatagaattttctccatatatgagtgtgttttaaagtaactgagttactgtagcagaagagctccttttataaacattagaaaccttgggcagagagaaaagatttttattaacgtccctcttcagtattaactcagacttggtcttccctaaaataatcagaataccatccca

SEQ ID NO: 305350 - DNA, 1905 bp, Homo sapiens
atctgtgcccggcggcgcaggacggcggtgggcggggctcacgcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttgaggtgacaggcttttaagaccgcctatgggcagcatccagagcggaccagctccctgtgctggaggactccagtgtgaggcctgctgcttcctttctacattggcctgaaaccagcccaactcagtggtcataatcttctgggcctaccgaagagcaaaagcctacttctagttcttccagttgccagttcaagggctttatctgtcacttcctttgggaacaggtagagtgctttgatttagaatgatggcaataaatgagaaaccaatttgaaattggatgtgagagtcttttgtcctttattgtgttgttcctgaacttgtagctaaggagggtagagtagagagagggatatataaccttatccaaggaaatagattagtaatacttcatccccaccacactttaatttgcacatatttctagagtataggacatcaaaaatacctagatattaaaatatttatgttgttaaccttcagctggtttagccgtatctattaaggatagaaaacaactgttcttcagttacttatcacatctgcttactaatttatgttatgtttatcatctcttcccatctaatagatgaaacaggcagataggtctggctcttccacttgctgacccagagttcac

SEQ ID NO: 305351 - DNA, 1784 bp, Homo sapiens
ctcggctgcaaaccccactagccagtgtcagcctctcggcgggagtgaggcggcggcggaggaggagcagggggagggctgtcaaattcgggagccagattttttcccttctcctggcaatcccttccgcttccccggctcccggcgtgacatctgcgggccggggacctgcatgtgtgtgcgcgcgaaggagcggaagaatggcagtgctcaaactcaccgaccagagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagctatactcatctgtttatatattatctgtggctgctttgaaatgagtagttgcaatagagatggtaaagcctacaaagcctaattatttactgtctggtttttgtcagaaaaaagtttgtcaatccttgttttagaagatggaaaaatgtgaagatctttggagattctcttgagtggtatatctaattgaaatgggatcttcgtttggcttgtatgttgatgaaatcaacttaggtatacaatataaaaaataaagaccctgaaaat

SEQ ID NO: 305352 - DNA, 1354 bp, Homo sapiens
atctgtgcccggcggcgcaggacggcggtgggcggggctcacgcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctggtaagtggcaaatgggaacttaccattttggggaaatgggatttgtgagcatatgctgttaattaaagaagatacagattatgcatcccaaatcctaaaatccaaaatgtaccaaaatctgaaactatttgagcaccaacatgacactcaaatgttcattggaccataagtataatgcaaatattccaaaatctgaaaaaaaaa

SEQ ID NO: 305353 - DNA, 1339 bp, Homo sapiens
agcggagttgcaacttcaactgtagagagctgaagtgtgggcttgttagtggtggatccgtacaggtctgaagcaacttgattcttgcctccttgaaggaaagaatttgtctaaggggcataaggcagagtgagagaccaagggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagctatactcatctgtttatatattatctgtggctgctttgaaatgagtagttgcaatagagatggtaaagcctacaaagcctaattatttactgtctggtttttgtcagaaaaaagtttgtcaatccttgttttagaagatggaaaaatgtgaagatctttggagattctcttgagtggtatatctaattgaaatgggatcttcgtttggcttgtatgttgatgaaatcaacttaggtatacaatataaaaaataaagaccctgaaaat

SEQ ID NO: 305354 - DNA, 1239 bp, Homo sapiens
caatgtgttcaatgctagtatctgcaatgagtagacagacattctcagggctgtagaggatatgaaaaagaggaatatactttggggatgcgattagaagtgggtacaaaagataaataaccatctctctcatctggcagaggtaaagtatggtaagtgtaaaaacaatacaaagaaaatactcaaagaattgaaaggaggaagagcttacctgtaagaaaggactagaagcttttttatgaaggttgcagtacagccggccttaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagctatactcatctgtttatatattatctgtggctgctttgaaatgagtagttgcaatagagatggtaaagcctacaaagcctaattatttactgtctggtttttgtcagaaaaaagtttgtcaatccttgttttagaagatggaaaaatgtgaagatctttggagattctcttgagtggtatatctaattgaaatgggatcttcgtttggcttgtatgttgatgaaatcaacttaggtatacaatataaaaaataaagaccctgaaaat

SEQ ID NO: 305355 - DNA, 6169 bp, Homo sapiens
ctcggctgcaaaccccactagccagtgtcagcctctcggcgggagtgaggcggcggcggaggaggagcagggggagggctgtcaaattcgggagccagattttttcccttctcctggcaatcccttccgcttccccggctcccggcgtgacatctgcgggccggggacctgcatgtgtgtgcgcgcgaaggagcggaagaatggcagtgctcaaactcaccgaccagccaccattggttcaggcaatcttcagcggtgatccagaggagatccggatgctcatccataaaactgaagatgtgaatactctggattctgagaaacgaacccctcttcatgtggccgcatttctgggagatgcagagatcattgaactcctgattttgtcaggagctcgtgtaaatgccaaggacaacatgtggctgactccactgcaccgggctgttgcttccagaagtgaagaagcagtacaggttttgattaagcactcagctgatgtcaatgcaagggacaagaactggcagacccctcttcatgtggcagcagccaacaaggctgtcaaatgtgcagaagtgatcattcccctgctgagcagtgtcaatgtctccgaccgaggggggcgcacagccttgcaccatgcggctctgaacggccacgtggagatggtcaatttactcttgggccaaaggggcaaaatatcaatgcatttgacaagaaggaccggcgtgctctgcactgggcagcatacatgggccacttggatgttgtagcattgctcattaaccatggcgcagaagtgacctgtaaggataagaagggttatacccctctgcatgctgcagcctccaatggacagattaatgttgtcaagcatctcctgaacctgggggtggagattgatgaaatcaatgtctatggaaatacagcgcttcacatcgcctgctacaatggacaggatgctgtggttaacgagttgattgactacggtgctaacgtgaaccagccaaacaataatgggttcacccctttgcattttgctgctgcctccactcatggtgctttgtgtcttgaattgttagtaaacaacggggcagatgttaacattcagagtaaagatggcaaaagtccactgcacatgacagctgtccatggaaggttcacacggtcacagaccctcattcagaatggaggtgaaattgactgtgtggataaggacggcaacactcctctccatgtggctgcaagatacggtcatgagcttttgattaacaccttaataaccagcggagctgacacagccaagtgtggaatccatagcatgttccctttacatttagctgccctaaatgctcactctgactgctgcagaaagttgttatcatcgggacaaaagtatagcatagtatccttgtttagtaatgagcacgtgctgtctgcaggctttgaaatagacaccccagataaatttggaagaacgtgccttcatgctgctgctgcaggaggtaatgtggaatgtataaaactcttgcagagcagcggagcagatttccataaaaaggacaagtgtgggaggacccctttgcactatgcagctgcgaattgtcatttccactgtattgagacattagtgaccacaggggccaacgttaatgaaacagatgactggggacgcacagctttgcattacgccgctgcatcagacatggatagaaataagactatcttaggaaatgcccatgataattcagaagaacttgaaagagccagggagctgaaggaaaaggaagccacactatgtctagagtttctgcttcaaaatgatgcaaatccatctatccgggacaaggaaggttacaatagcatacattatgctgccgcctatgggcacaggcagtgtctggaattgcttttggaaagaacaaacagtggatttgaagaatcagattctggtgctactaagagtccactccacttagctgcctacaatgggcaccatcaagccttggaagtccttctgcagtcgttggtggacctggacatcagggatgagaaaggccgcactgctctggatctggctgcctttaaaggacacacagaatgtgtggaagcgcttatcaatcagggcgcatccatctttgtgaaagacaatgtaaccaaaagaaccccacttcatgcctcagtaattaatggtcacacactgtgtttacggctgttgctagaaattgcagacaacccggaggcggtcgatgtgaaagatgccaaaggacaaacaccactgatgcttgcagtagcatatggacatattgacgctgtttcattgttacttgaaaaggaagccaacgtagacactgttgacatcctaggatgcacagctttacacagagggattatgacaggacacgaggaatgtgtgcaaatgctgctggaacaagaagtgtcaattctctgtaaagattccagagggaggacgcccttgcactatgcagctgctcgtggccacgccacgtggctgagcgagctgctccaaatggctctttctgaggaggactgttgtttcaaagataaccaaggctacacgccgctgcactgggcttgttacaatggtaatgaaaactgtatagaggtacttttggagcaaaaatgttttcgcaaatttatcggtaatccctttactccactgcactgtgcaataatcaatgatcatgggaattgtgcatcattgctgcttggggccatagattccagtatcgtcagttgtagagatgacaaaggcaggacaccccttcatgcggcagcatttgctgatcatgtggagtgcttgcagcttcttctgagacacagtgctccagtgaacgcagtagataattcagggaaaacagcactgatgatggctgctgagaatgggcaggcaggcgctgtggatattttggtgaacagtgcccaggctgatctgactgtaaaggataaggacttgaatacacccttacatttggcttgtagtaaaggtcatgaaaaatgtgccttgttaatacttgacaagatacaagacgagagccttattaatgaaaaaaataatgcactgcagacacccctccacgtcgctgcgcgcaatggcttaaaggtggtagttgaggagttgctggccaaaggggcctgtgtacttgctgtagatgaaaatgcttctaggtcaaatggaccccgttccacacctggaaccgctgtacaaaaagaagaatgagactctttaaaaattatgcacatacacatgcacacatatatgtgtgcgtgtgtatatatatatatatgtgtgtgtgtgtgtgtagttcatcagccagctacacatgaggaccaaaatgcttcagtctaaaatggaagatacacatttttttccttcaaaatgcaagtgagaactgaagtagcttttttatggagttaaatgtaatctttctgtgtaccagtctttgttgtattttatatttcttaggacacagatttctagttgaccacttaacatttgtaactgatgatgtgttgacctttttttttttttttgccaaactagagaaaatgtccatatacttttgctgtaaatgtgtttatatttatttgaaatgaaacaaatggtgaggaaacatccattatttgttctctattttaattgctatgtatcttatttagaataacaaaaaaaaagtgaaaaaaaaaacacttgaccctgggctagccaaaagcccaagggccaaacctagcatttccactgctaaggtttccagatgaccctcaggttcttccgcgttggttagagagggctacgcatcttctactgctcagccacagtctgtagccagcttagagcttagaagacattgcagtctggatgcccttctgcgagatgaaaactcagatgtgtagtggatcatatacacaaaggcagcacaaagaaatatctagaaattaccctaagtacactgaaaagctcacatagtctcagtaacctgatgagaaatgatggcagtgtgtgggcacatgtgccaaaaggagaaataaaaatcaccagctcaagtgctattttctacttgaggaagagacagaaaagaaatgtgtcgaattagagcagtactctctgacgttttataatgagttccatttccaccctggaaattgctattttatagtgtatgtgagatatttcaaaaataatgttctatcatatctggatcaaagacagataactgtattatatttttcatctagctataaaactttaatcttactcttaatatcctggatttaattcaaactcctgttgggttcttcacaaatgagaacttgttcaaaggatttattgaactggtattgatttcactgaaaattttccacaccaccaccattgtttttttgaattcttggtgttgtgcttcccaccttctgtccttttcgtttgtttagagaagatgaatttttaaaaagcagataaattgctaatgagcaataatgaccttatctttaccaaaacactgaaaattaagagaggttcagtgttgaagaagcacaatatgctgcggtgtctttttctagaagtgaatggaaatcttgctcagttggcatttcaagcaggaaatgaaatgcttgctttaatggcaaagcagcgttaacatttttcctgtcgtgtagcagagagtacaagaatcatttcagcaaagcagtgactcaccatgagacgttatctccatggagctgcgttttgacttttcccactctcttactcatagaaggaggacaaaggaacgaaatgaaatcatgctcacaatgaactgttcattacatcaactgatctctctctctctctcttcctctctttctctttctcccataccccaaggcaaaatttttttaaagaaatgactttaaaaactatcatttctgtattttaattacatctcttagaaataaaattatgtttgcaccatagctttctaagaaaaaaaaatgtgtttttaactgagtcttagttgcttagtgcttttatttgtgttatttttagactgtattttaaccacaactacaaggatcatgtttcattgcacttacttatttgccagtgtctgcctgtctttgctaaatacattactatctccaaattgcctaaaatctgctatgattctacagtaaatagctcagggtatttctatttatcactactaaaagggcaccatagtatgttttggtactttaggcagtaaacactgcttggtttatcattttgttattaaattagaacaagaacatcaaatggatttgctgcactagttattctttgtactgttgagcaacttggtgtgcttatatgttgtgttggttgaagaactcatccgttttattgtcttgtaatatgaagttagagtgcctttttatatttgtatattctgaaaatgttctgtggaatgttttgtattttttcatttgagtgttatcagagcaatatgataccagtgagttttcatttcaacttttctttgaatgtataaagtgtcttttttcctatttccccttgtacttgcattgaaatgaatatgaaaatgcttaagttttctataggaattgtttgattttgcagtgctaaaatgctttcgtcttacgaaactataaaccataggtcagtattataggggaaaagcattttaagatagtgacaatctgagtgtttgtataaaatgtaattctatgcgtttcttatgtgatctaaaaattcaatgcaaatatcttttatttggtagttttgtctacatattttatgctctagcatgtgcaatatatctttgtaaagcacgatgatacaaatctggtgccagtgttatattttgcataacatatttgtaacagcataaaatattgtttgatgatttcagtgggattttgtctataatgttttcttatgtaaattggagttgaatgactctggtaaatgtcatgactgtaaaaatggggaaaatgacttttagttcagtgaatgactttgaaacaatctgaatcttctcaagcacagtttaatacttttgcaactactgaatgctctaataacgtaatgaagtacttaactgtaatatactatggaaatgcattcagatggttatttttacaaataaaaacggtacaaatattgttggaa

SEQ ID NO: 305356 - DNA, 3924 bp, Homo sapiens
cctgggcttccagaagctagtagagaaggaattaatcgagggagggcagtgaggctgttgggtggaacagtcacacagatggccccagttttgttttgtttcacattttctttaaatctaagatacttctgtgaaagtctacctctcattttaaataaagaataaaagatgtatttaattcctgttctttggggataatgcagcagagaggcagctgttcgctatgaataatttttcttttcatgtatttagcagtgagttctcagaagtatatcagtgtgacattcatgtcccctgggagggaagggaagaggcagataggaaatgcctcaaacttcttctcactttgatgtttacttcctcactagaagccaaaggtaaaggtgtccatcttcagaaataatgcctgtaataatctttttagagagtccaactatttatatcctctctatagtaagcatttgaatatccagaacttctttctgaggatctctgttaaagttgccagatgaattgaaaaattgaacttgctttttttgtttaacacagtgttccctataacaagcctgtgactaattttcacttaagtgattgaacccaaatttatctaataacatttcaggtgaaaattatattgcaccaaaactttgacacaatatgcaaaaatagtatgaaactaccctttgttaatttattcttaaatcaaaatactaacttttaaaaaacatcagaatcatcagcattgttcatcagtagtaaaatgagcttctcagtcaaggtcataccaagtcagtgaaaagtgtgactgcaaaaaaggaacaaaaaaagtgaaagcagaaagtagaaatgggtgatttagcatgtaaaaccgattgccagttgcttgatgatgaaatcaacatagtgaatactgtgtctgctccctctgccaaagcttctaggtcaaatggaccccgttccacacctggaaccgctgtacaaaaagaagaatgagactctttaaaaattatgcacatacacatgcacacatatatgtgtgcgtgtgtatatatatatatatgtgtgtgtgtgtgtgtagttcatcagccagctacacatgaggaccaaaatgcttcagtctaaaatggaagatacacatttttttccttcaaaatgcaagtgagaactgaagtagcttttttatggagttaaatgtaatctttctgtgtaccagtctttgttgtattttatatttcttaggacacagatttctagttgaccacttaacatttgtaactgatgatgtgttgacctttttttttttttttgccaaactagagaaaatgtccatatacttttgctgtaaatgtgtttatatttatttgaaatgaaacaaatggtgaggaaacatccattatttgttctctattttaattgctatgtatcttatttagaataacaaaaaaaaagtgaaaaaaaaaacacttgaccctgggctagccaaaagcccaagggccaaacctagcatttccactgctaaggtttccagatgaccctcaggttcttccgcgttggttagagagggctacgcatcttctactgctcagccacagtctgtagccagcttagagcttagaagacattgcagtctggatgcccttctgcgagatgaaaactcagatgtgtagtggatcatatacacaaaggcagcacaaagaaatatctagaaattaccctaagtacactgaaaagctcacatagtctcagtaacctgatgagaaatgatggcagtgtgtgggcacatgtgccaaaaggagaaataaaaatcaccagctcaagtgctattttctacttgaggaagagacagaaaagaaatgtgtcgaattagagcagtactctctgacgttttataatgagttccatttccaccctggaaattgctattttatagtgtatgtgagatatttcaaaaataatgttctatcatatctggatcaaagacagataactgtattatatttttcatctagctataaaactttaatcttactcttaatatcctggatttaattcaaactcctgttgggttcttcacaaatgagaacttgttcaaaggatttattgaactggtattgatttcactgaaaattttccacaccaccaccattgtttttttgaattcttggtgttgtgcttcccaccttctgtccttttcgtttgtttagagaagatgaatttttaaaaagcagataaattgctaatgagcaataatgaccttatctttaccaaaacactgaaaattaagagaggttcagtgttgaagaagcacaatatgctgcggtgtctttttctagaagtgaatggaaatcttgctcagttggcatttcaagcaggaaatgaaatgcttgctttaatggcaaagcagcgttaacatttttcctgtcgtgtagcagagagtacaagaatcatttcagcaaagcagtgactcaccatgagacgttatctccatggagctgcgttttgacttttcccactctcttactcatagaaggaggacaaaggaacgaaatgaaatcatgctcacaatgaactgttcattacatcaactgatctctctctctctctcttcctctctttctctttctcccataccccaaggcaaaatttttttaaagaaatgactttaaaaactatcatttctgtattttaattacatctcttagaaataaaattatgtttgcaccatagctttctaagaaaaaaaaatgtgtttttaactgagtcttagttgcttagtgcttttatttgtgttatttttagactgtattttaaccacaactacaaggatcatgtttcattgcacttacttatttgccagtgtctgcctgtctttgctaaatacattactatctccaaattgcctaaaatctgctatgattctacagtaaatagctcagggtatttctatttatcactactaaaagggcaccatagtatgttttggtactttaggcagtaaacactgcttggtttatcattttgttattaaattagaacaagaacatcaaatggatttgctgcactagttattctttgtactgttgagcaacttggtgtgcttatatgttgtgttggttgaagaactcatccgttttattgtcttgtaatatgaagttagagtgcctttttatatttgtatattctgaaaatgttctgtggaatgttttgtattttttcatttgagtgttatcagagcaatatgataccagtgagttttcatttcaacttttctttgaatgtataaagtgtcttttttcctatttccccttgtacttgcattgaaatgaatatgaaaatgcttaagttttctataggaattgtttgattttgcagtgctaaaatgctttcgtcttacgaaactataaaccataggtcagtattataggggaaaagcattttaagatagtgacaatctgagtgtttgtataaaatgtaattctatgcgtttcttatgtgatctaaaaattcaatgcaaatatcttttatttggtagttttgtctacatattttatgctctagcatgtgcaatatatctttgtaaagcacgatgatacaaatctggtgccagtgttatattttgcataacatatttgtaacagcataaaatattgtttgatgatttcagtgggattttgtctataatgttttcttatgtaaattggagttgaatgactctggtaaatgtcatgactgtaaaaatggggaaaatgacttttagttcagtgaatgactttgaaacaatctgaatcttctcaagcacagtttaatacttttgcaactactgaatgctctaataacgtaatgaagtacttaactgtaatatactatggaaatgcattcagatggttatttttacaaataaaaacggtacaaatattgttggaa

SEQ ID NO: 305357 - DNA, 5991 bp, Homo sapiens
ttaggggaagggggcgtaaccccatctccccggttaaagtggacggcatccaccattggttcaggcaatcttcagcggtgatccagaggagatccggatgctcatccataaaactgaagatgtgaatactctggattctgagaaacgaacccctcttcatgtggccgcatttctgggagatgcagagatcattgaactcctgattttgtcaggagctcgtgtaaatgccaaggacaacatgtggctgactccactgcaccgggctgttgcttccagaagtgaagaagcagtacaggttttgattaagcactcagctgatgtcaatgcaagggacaagaactggcagacccctcttcatgtggcagcagccaacaaggctgtcaaatgtgcagaagtgatcattcccctgctgagcagtgtcaatgtctccgaccgaggggggcgcacagccttgcaccatgcggctctgaacggccacgtggagatggtcaatttactcttgggccaaaggggcaaaatatcaatgcatttgacaagaaggaccggcgtgctctgcactgggcagcatacatgggccacttggatgttgtagcattgctcattaaccatggcgcagaagtgacctgtaaggataagaagggttatacccctctgcatgctgcagcctccaatggacagattaatgttgtcaagcatctcctgaacctgggggtggagattgatgaaatcaatgtctatggaaatacagcgcttcacatcgcctgctacaatggacaggatgctgtggttaacgagttgattgactacggtgctaacgtgaaccagccaaacaataatgggttcacccctttgcattttgctgctgcctccactcatggtgctttgtgtcttgaattgttagtaaacaacggggcagatgttaacattcagagtaaagatggcaaaagtccactgcacatgacagctgtccatggaaggttcacacggtcacagaccctcattcagaatggaggtgaaattgactgtgtggataaggacggcaacactcctctccatgtggctgcaagatacggtcatgagcttttgattaacaccttaataaccagcggagctgacacagccaagtgtggaatccatagcatgttccctttacatttagctgccctaaatgctcactctgactgctgcagaaagttgttatcatcgggacaaaagtatagcatagtatccttgtttagtaatgagcacgtgctgtctgcaggctttgaaatagacaccccagataaatttggaagaacgtgccttcatgctgctgctgcaggaggtaatgtggaatgtataaaactcttgcagagcagcggagcagatttccataaaaaggacaagtgtgggaggacccctttgcactatgcagctgcgaattgtcatttccactgtattgagacattagtgaccacaggggccaacgttaatgaaacagatgactggggacgcacagctttgcattacgccgctgcatcagacatggatagaaataagactatcttaggaaatgcccatgataattcagaagaacttgaaagagccagggagctgaaggaaaaggaagccacactatgtctagagtttctgcttcaaaatgatgcaaatccatctatccgggacaaggaaggttacaatagcatacattatgctgccgcctatgggcacaggcagtgtctggaattgcttttggaaagaacaaacagtggatttgaagaatcagattctggtgctactaagagtccactccacttagctgcctacaatgggcaccatcaagccttggaagtccttctgcagtcgttggtggacctggacatcagggatgagaaaggccgcactgctctggatctggctgcctttaaaggacacacagaatgtgtggaagcgcttatcaatcagggcgcatccatctttgtgaaagacaatgtaaccaaaagaaccccacttcatgcctcagtaattaatggtcacacactgtgtttacggctgttgctagaaattgcagacaacccggaggcggtcgatgtgaaagatgccaaaggacaaacaccactgatgcttgcagtagcatatggacatattgacgctgtttcattgttacttgaaaaggaagccaacgtagacactgttgacatcctaggatgcacagctttacacagagggattatgacaggacacgaggaatgtgtgcaaatgctgctggaacaagaagtgtcaattctctgtaaagattccagagggaggacgcccttgcactatgcagctgctcgtggccacgccacgtggctgagcgagctgctccaaatggctctttctgaggaggactgttgtttcaaagataaccaaggctacacgccgctgcactgggcttgttacaatggtaatgaaaactgtatagaggtacttttggagcaaaaatgttttcgcaaatttatcggtaatccctttactccactgcactgtgcaataatcaatgatcatgggaattgtgcatcattgctgcttggggccatagattccagtatcgtcagttgtagagatgacaaaggcaggacaccccttcatgcggcagcatttgctgatcatgtggagtgcttgcagcttcttctgagacacagtgctccagtgaacgcagtagataattcagggaaaacagcactgatgatggctgctgagaatgggcaggcaggcgctgtggatattttggtgaacagtgcccaggctgatctgactgtaaaggataaggacttgaatacacccttacatttggcttgtagtaaaggtcatgaaaaatgtgccttgttaatacttgacaagatacaagacgagagccttattaatgaaaaaaataatgcactgcagacacccctccacgtcgctgcgcgcaatggcttaaaggtggtagttgaggagttgctggccaaaggggcctgtgtacttgctgtagatgaaaatgcttctaggtcaaatggaccccgttccacacctggaaccgctgtacaaaaagaagaatgagactctttaaaaattatgcacatacacatgcacacatatatgtgtgcgtgtgtatatatatatatatgtgtgtgtgtgtgtgtagttcatcagccagctacacatgaggaccaaaatgcttcagtctaaaatggaagatacacatttttttccttcaaaatgcaagtgagaactgaagtagcttttttatggagttaaatgtaatctttctgtgtaccagtctttgttgtattttatatttcttaggacacagatttctagttgaccacttaacatttgtaactgatgatgtgttgacctttttttttttttttgccaaactagagaaaatgtccatatacttttgctgtaaatgtgtttatatttatttgaaatgaaacaaatggtgaggaaacatccattatttgttctctattttaattgctatgtatcttatttagaataacaaaaaaaaagtgaaaaaaaaaacacttgaccctgggctagccaaaagcccaagggccaaacctagcatttccactgctaaggtttccagatgaccctcaggttcttccgcgttggttagagagggctacgcatcttctactgctcagccacagtctgtagccagcttagagcttagaagacattgcagtctggatgcccttctgcgagatgaaaactcagatgtgtagtggatcatatacacaaaggcagcacaaagaaatatctagaaattaccctaagtacactgaaaagctcacatagtctcagtaacctgatgagaaatgatggcagtgtgtgggcacatgtgccaaaaggagaaataaaaatcaccagctcaagtgctattttctacttgaggaagagacagaaaagaaatgtgtcgaattagagcagtactctctgacgttttataatgagttccatttccaccctggaaattgctattttatagtgtatgtgagatatttcaaaaataatgttctatcatatctggatcaaagacagataactgtattatatttttcatctagctataaaactttaatcttactcttaatatcctggatttaattcaaactcctgttgggttcttcacaaatgagaacttgttcaaaggatttattgaactggtattgatttcactgaaaattttccacaccaccaccattgtttttttgaattcttggtgttgtgcttcccaccttctgtccttttcgtttgtttagagaagatgaatttttaaaaagcagataaattgctaatgagcaataatgaccttatctttaccaaaacactgaaaattaagagaggttcagtgttgaagaagcacaatatgctgcggtgtctttttctagaagtgaatggaaatcttgctcagttggcatttcaagcaggaaatgaaatgcttgctttaatggcaaagcagcgttaacatttttcctgtcgtgtagcagagagtacaagaatcatttcagcaaagcagtgactcaccatgagacgttatctccatggagctgcgttttgacttttcccactctcttactcatagaaggaggacaaaggaacgaaatgaaatcatgctcacaatgaactgttcattacatcaactgatctctctctctctctcttcctctctttctctttctcccataccccaaggcaaaatttttttaaagaaatgactttaaaaactatcatttctgtattttaattacatctcttagaaataaaattatgtttgcaccatagctttctaagaaaaaaaaatgtgtttttaactgagtcttagttgcttagtgcttttatttgtgttatttttagactgtattttaaccacaactacaaggatcatgtttcattgcacttacttatttgccagtgtctgcctgtctttgctaaatacattactatctccaaattgcctaaaatctgctatgattctacagtaaatagctcagggtatttctatttatcactactaaaagggcaccatagtatgttttggtactttaggcagtaaacactgcttggtttatcattttgttattaaattagaacaagaacatcaaatggatttgctgcactagttattctttgtactgttgagcaacttggtgtgcttatatgttgtgttggttgaagaactcatccgttttattgtcttgtaatatgaagttagagtgcctttttatatttgtatattctgaaaatgttctgtggaatgttttgtattttttcatttgagtgttatcagagcaatatgataccagtgagttttcatttcaacttttctttgaatgtataaagtgtcttttttcctatttccccttgtacttgcattgaaatgaatatgaaaatgcttaagttttctataggaattgtttgattttgcagtgctaaaatgctttcgtcttacgaaactataaaccataggtcagtattataggggaaaagcattttaagatagtgacaatctgagtgtttgtataaaatgtaattctatgcgtttcttatgtgatctaaaaattcaatgcaaatatcttttatttggtagttttgtctacatattttatgctctagcatgtgcaatatatctttgtaaagcacgatgatacaaatctggtgccagtgttatattttgcataacatatttgtaacagcataaaatattgtttgatgatttcagtgggattttgtctataatgttttcttatgtaaattggagttgaatgactctggtaaatgtcatgactgtaaaaatggggaaaatgacttttagttcagtgaatgactttgaaacaatctgaatcttctcaagcacagtttaatacttttgcaactactgaatgctctaataacgtaatgaagtacttaactgtaatatactatggaaatgcattcagatggttatttttacaaataaaaacggtacaaatattgttggaa

SEQ ID NO: 305358 - DNA, 1124 bp, Homo sapiens
caatgtgttcaatgctagtatctgcaatgagtagacagacattctcagggctgtagaggatatgaaaaagaggaatatactttggggatgcgattagaagtgggtacaaaagataaataaccatctctctcatctggcagaggtaaagtatgttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagctatactcatctgtttatatattatctgtggctgctttgaaatgagtagttgcaatagagatggtaaagcctacaaagcctaattatttactgtctggtttttgtcagaaaaaagtttgtcaatccttgttttagaagatggaaaaatgtgaagatctttggagattctcttgagtggtatatctaattgaaatgggatcttcgtttggcttgtatgttgatgaaatcaacttaggtatacaatataaaaaataaagaccctgaaaat

SEQ ID NO: 305359 - DNA, 935 bp, Homo sapiens
gtatttttctacaagaaaattttcttttttttttaaattaccctctagagtcttttattgatcgagactaatgtttttatcttgaggaacacactgactaaattaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagctatactcatctgtttatatattatctgtggctgctttgaaatgagtagttgcaatagagatggtaaagcctacaaagcctaattatttactgtctggtttttgtcagaaaaaagtttgtcaatccttgttttagaagatggaaaaatgtgaagatctttggagattctcttgagtggtatatctaattgaaatgggatcttcgtttggcttgtatgttgatgaaatcaacttaggtatacaatataaaaaataaagaccctgaaaat

SEQ ID NO: 305360 - DNA, 835 bp, Homo sapiens
atctgtgcccggcggcgcaggacggcggtgggcggggctcacgcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctgaaaagaatggagatgacactattacatagtagttgaaactccttgtgttacatgtggcagaagacccaattc

SEQ ID NO: 305361 - DNA, 3607 bp, Homo sapiens
  misc_feature (3472)..(3472): n is a, c, g, or t
ctcggctgcaaaccccactagccagtgtcagcctctcggcgggagtgaggcggcggcggaggaggagcagggggagggctgtcaaattcgggagccagattttttcccttctcctggcaatcccttccgcttccccggctcccggcgtgacatctgcgggccggggacctgcatgtgtgtgcgcgcgaaggagcggaagaatggcagtgctcaaactcaccgaccagccaccattggttcaggcaatcttcagcggtgatccagaggagatccggatgctcatccataaaactgaagatgtgaatactctggattctgagaaacgaacccctcttcatgtggccgcatttctgggagatgcagagatcattgaactcctgattttgtcaggagctcgtgtaaatgccaaggacaacatgtggctgactccactgcaccgggctgttgcttccagaagtgaagaagcagtacaggttttgattaagcactcagctgatgtcaatgcaagggacaagaactggcagacccctcttcatgtggcagcagccaacaaggctgtcaaatgtgcagaagtgatcattcccctgctgagcagtgtcaatgtctccgaccgaggggggcgcacagccttgcaccatgcggctctgaacggccacgtggagatggtcaatttactcttgggccaaaggggcaaaatatcaatgcatttgacaagaaggaccggcgtgctctgcactgggcagcatacatgggccacttggatgttgtagcattgctcattaaccatggcgcagaagtgacctgtaaggataagaagggttatacccctctgcatgctgcagcctccaatggacagattaatgttgtcaagcatctcctgaacctgggggtggagattgatgaaatcaatgtctatggaaatacagcgcttcacatcgcctgctacaatggacaggatgctgtggttaacgagttgattgactacggtgctaacgtgaaccagccaaacaataatgggttcacccctttgcattttgctgctgcctccactcatggtgctttgtgtcttgaattgttagtaaacaacggggcagatgttaacattcagagtaaagatggcaaaagtccactgcacatgacagctgtccatggaaggttcacacggtcacagaccctcattcagaatggaggtgaaattgactgtgtggataaggacggcaacactcctctccatgtggctgcaagatacggtcatgagcttttgattaacaccttaataaccagcggagctgacacagccaagtgtggaatccatagcatgttccctttacatttagctgccctaaatgctcactctgactgctgcagaaagttgttatcatcgggacaaaagtatagcatagtatccttgtttagtaatgagcacgtgctgtctgcaggctttgaaatagacaccccagataaatttggaagaacgtgccttcatgctgctgctgcaggaggtaatgtggaatgtataaaactcttgcagagcagcggagcagatttccataaaaaggacaagtgtgggaggacccctttgcactatgcagctgcgaattgtcatttccactgtattgagacattagtgaccacaggggccaacgttaatgaaacagatgactggggacgcacagctttgcattacgccgctgcatcagacatggatagaaataagactatcttaggaaatgcccatgataattcagaagaacttgaaagagccagggagctgaaggaaaaggaagccacactatgtctagagtttctgcttcaaaatgatgcaaatccatctatccgggacaaggaaggttacaatagcatacattatgctgccgcctatgggcacaggcagtgtctggaattgcttttggaaagaacaaacagtggatttgaagaatcagattctggtgctactaagagtccactccacttagctgcctacaatgggcaccatcaagccttggaagtccttctgcagtcgttggtggacctggacatcagggatgagaaaggccgcactgctctggatctggctgcctttaaaggacacacagaatgtgtggaagcgcttatcaatcagggcgcatccatctttgtgaaagacaatgtaaccaaaagaaccccacttcatgcctcagtaattaatggtcacacactgtgtttacggctgttgctagaaattgcagacaacccggaggcggtcgatgtgaaagatgccaaaggacaaacaccactgatgcttgcagtagcatatggacatattgacgctgtttcattgttacttgaaaaggaagccaacgtagacactgttgacatcctaggatgcacagctttacacagagggattatgacaggacacgaggaatgtgtgcaaatgctgctggaacaagaagtgtcaattctctgtaaagattccagagggaggacgcccttgcactatgcagctgctcgtggccacgccacgtggctgagcgagctgctccaaatggctctttctgaggaggactgttgtttcaaagataaccaaggctacacgccgctgcactgggcttgttacaatggtaatgaaaactgtatagaggtacttttggagcaaaaatgttttcgcaaatttatcggtaatccctttactccactgcactgtgcaataatcaatgatcatgggaattgtgcatcattgctgcttggggccatagattccagtatcgtcagttgtagagatgacaaaggcaggacaccccttcatgcggcagcatttgctgatcatgtggagtgcttgcagcttcttctgagacacagtgctccagtgaacgcagtagataattcagggaaaacagcactgatgatggctgctgagaatgggcaggcaggcgctgtggatattttggtgaacagtgcccaggctgatctgactgtaaaggataaggacttgaatacacccttacatttggcttgtagtaaaggtcatgaaaaatgtgccttgttaatacttgacaagatacaagacgagagccttattaatgaaaaaaataatgcactgcagacacccctccacgtcgctgcgcgcaatggcttaaaggtggtagttgaggagttgctggccaaaggggcctgtgtacttgctgtagatgaaaatggctgttaaccattcaagatccaagaacatcggttggctgcaaaacaggcaccctgagggaccaattatgaatcagaatgcactttatcccagccacagaacgcaaagggttacactctgcaggagctgcggttggggaagggaaagggagtaaccggattcgccttgcctgtctgtgattgggaagcacgcaccctttattttccaactgggaacaagatactggaaattcctctttcccttagaaaacagaaggcaagggtgttggctgtggaaattagaactgggtaatanttctagagcactttgaaattctttcaggataagtgttatacgaacacaaatgatttctttcattgttaaattgtgttcctatcattggtaacgccccaagtaaagcctttttaattaaaaatctctggatgctat

SEQ ID NO: 305362 - DNA, 917 bp, Homo sapiens
gtgaaattgggctggatgaagagcaaagtgaagccagcacagatggggagaaagtcataggatctgtggacctcagtaagatcaatgatttgtagcagtggagatacttgagcaaataagatttaggaggtggtgatcagagagtgggctatcagaggtggttcagtctctgaatgtcatggttcaggttgtggccatgggagtggaaggctgaagtgaatagaggagagagaaaataacccagaataaggacacccagaaattatccccatttaatctcaattttctttcagagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagctatactcatctgtttatatattatctgtggctgctttgaaatgagtagttgcaatagagatggtaaagcctacaaagcctaattatttactgtctggtttttgtcagaaaaaagtttgtcaatccttgttttagaagatggaaaaatgtgaagatctttggagattctcttgagtggtatatctaattgaaatgggatcttcgtttggcttgtatgttgatgaaatcaacttaggtatacaatataaaaaataaagaccctgaaaat

SEQ ID NO: 305363 - DNA, 736 bp, Homo sapiens
aaaatagaatacatataaaaattttgcaggaaaaaagtatgatagaaaaatgtgcctagtataagaatttctgtcaattcagtaagtaaaatctagcaatattagacaaaaataatggtattaacatttgtatcttctcttgacagttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagctatactcatctgtttatatattatctgtggctgctttgaaatgagtagttgcaatagagatggtaaagcctacaaagcctaattatttactgtctggtttttgtcagaaaaaagtttgtcaatccttgttttagaagatggaaaaatgtgaagatctttggagattctcttgagtggtatatctaattgaaatgggatcttcgtttggcttgtatgttgatgaaatcaacttaggtatacaatataaaaaataaagaccctgaaaat

SEQ ID NO: 305364 - DNA, 1648 bp, Homo sapiens
ctcggctgcaaaccccactagccagtgtcagcctctcggcgggagtgaggcggcggcggaggaggagcagggggagggctgtcaaattcgggagccagattttttcccttctcctggcaatcccttccgcttccccggctcccggcgtgacatctgcgggccggggacctgcatgtgtgtgcgcgcgaaggagcggaagaatggcagtgctcaaactcaccgaccagccaccattggttcaggcaatcttcagcggtgatccagaggagatccggatgctcatccataaaactgaagatgtgaatactctggattctgagaaacgaacccctcttcatgtggccgcatttctgggagatgcagagatcattgaactcctgattttgtcaggagctcgtgtaaatgccaaggacaacatgtggctgactccactgcaccgggctgttgcttccagaagtgaagaagcagtacaggttttgattaagcactcagctgatgtcaatgcaagggacaagaactggcagacccctcttcatgtggcagcagccaacaaggctgtcaaatgtgcagaagtgatcattcccctgctgagcagtgtcaatgtctccgaccgaggggggcgcacagccttgcaccatgcggctctgaacggccacgtggagatggtcaatttactcttgggccaaaggggcaaaatatcaatgcatttgacaagaaggaccggcgtgctctgcactgggcagcatacatgggccacttggatgttgtagcattgctcattaaccatggcgcagaagtgacctgtaaggataagaagggttatacccctctgcatgctgcagcctccaatggacagattaatgttgtcaagcatctcctgaacctgggggtggagattgatgaaatcaatgtctatggaaatacagcgcttcacatcgcctgctacaatggacaggatgctgtggttaacgagttgattgactacggtgctaacgtgaaccagccaaacaataatgggttcacccctttgcattttgctgctgcctccactcatggtgctttgtgtcttgaattgttagtaaacaacggggcagatgttaacattcagagtaaagatggcaaaagtccactgcacatgacagctgtccatggaaggttcacacggtcacagaccctcattcagaatggaggtgaaattgactgtgtggataaggacggcaacactcctctccatgtggctgcaagatacggtcatgagcttttgattaacaccttaataaccagcggagctgacacagccaagtaggttaccgcaaaaatacggtggaataattgcctcaagtgggaatactgccaaaaagattcttccgtgcagtagatagttcccatttatccaggttaaggtggatctataccattatactaaatacaaattaaattttaaataaattaagtgccttttaatgacagaggcaaagaagaaccaattttattttttagcttcatccaaatgaggtctatttcagtggttttaattaaggaaacttgaactttattcgtaacttttctttctaatattcttctgtccttcccaatgcttcatattaaacaggaaaaataaaacctaactgagccaatttaaaatgta

SEQ ID NO: 305365 - DNA, 729 bp, Homo sapiens
atctgtgcccggcggcgcaggacggcggtgggcggggctcacgcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggaatggttcccttgaaggggggggggaaggttttattatttggccaaagagttcccaaagggagaaaattgaggggtacctttccccttggccataaaaacgaggga

SEQ ID NO: 305366 - DNA, 2037 bp, Homo sapiens
ctcggctgcaaaccccactagccagtgtcagcctctcggcgggagtgaggcggcggcggaggaggagcagggggagggctgtcaaattcgggagccagattttttcccttctcctggcaatcccttccgcttccccggctcccggcgtgacatctgcgggccggggacctgcatgtgtgtgcgcgcgaaggagcggaagaatggcagtgctcaaactcaccgaccagccaccattggttcaggcaatcttcagcggtgatccagaggagatccggatgctcatccataaaactgaagatgtgaatactctggattctgagaaacgaacccctcttcatgtggccgcatttctgggagatgcagagatcattgaactcctgattttgtcaggagctcgtgtaaatgccaaggacaacatgtggctgactccactgcaccgggctgttgcttccagaagtgaagaagcagtacaggttttgattaagcactcagctgatgtcaatgcaagggacaagaactggcagacccctcttcatgtggcagcagccaacaaggctgtcaaatgtgcagaagtgatcattcccctgctgagcagtgtcaatgtctccgaccgaggggggcgcacagccttgcaccatgcggctctgaacggccacgtggagatggtcaatttactcttgggccaaaggggcaaaatatcaatgcatttgacaagaaggaccggcgtgctctgcactgggcagcatacatgggccacttggatgttgtagcattgctcattaaccatggcgcagaagtgacctgtaaggataagaagggttatacccctctgcatgctgcagcctccaatggacagattaatgttgtcaagcatctcctgaacctgggggtggagattgatgaaatcaatgtctatggaaatacagcgcttcacatcgcctgctacaatggacaggatgctgtggttaacgagttgattgactacggtgctaacgtgaaccagccaaacaataatgggttcacccctttgcattttgctgctgcctccactcatggtgctttgtgtcttgaattgttagtaaacaacggggcagatgttaacattcagagtaaagatggcaaaagtccactgcacatgacagctgtccatggaaggttcacacggtcacagaccctcattcagaatggaggtgaaattgactgtgtggataaggacggcaacactcctctccatgtggctgcaagatacggtcatgagcttttgattaacaccttaataaccagcggagctgacacagccaagtgtggaatccatagcatgttccctttacatttagctgccctaaatgctcactctgactgctgcagaaagttgttatcatcgggacaaaagtatagcatagtatccttgtttagtaatgagcacgtgctgtctgcaggctttgaaatagacaccccagataaatttggaagaacgtgccttcatgctgctgctgcaggaggtaatgtggaatgtataaaactcttgcagagcagcggagcagatttccataaaaaggacaagtgtgggaggacccctttgcactatgcagctgcgaattgtcatttccactgtattgagacattagtgaccacaggggccaacgttaatgaaacagatgactggggacgcacagctttgcattacgccgctgcatcagacatggatagaaataagactatcttaggaaatgcccatgataattcagaagaacttgaaagagccagggagctgaaggaaaaggaagccacactatgtctagagtttctgcttcaaaatgatgcaaatccatctatccgggacaaggaaggttacaatagcatacattatgctgccgcctatgggcacaggcagtgtctggaattgcttttggaaagaacaaacagtggatttgaagaatcagattctggtgctactaagagtccactccacttagctgcctacaatgggcaccatcaagcctgggtgacagagtgagaccctgtctcaaaaaaaaa

SEQ ID NO: 305367 - DNA, 3296 bp, Homo sapiens
ctcggctgcaaaccccactagccagtgtcagcctctcggcgggagtgaggcggcggcggaggaggagcagggggagggctgtcaaattcgggagccagattttttcccttctcctggcaatcccttccgcttccccggctcccggcgtgacatctgcgggccggggacctgcatgtgtgtgcgcgcgaaggagcggaagaatggcagtgctcaaactcaccgaccagccaccattggttcaggcaatcttcagcggtgatccagaggagatccggatgctcatccataaaactgaagatgtgaatactctggattctgagaaacgaacccctcttcatgtggccgcatttctgggagatgcagagatcattgaactcctgattttgtcaggagctcgtgtaaatgccaaggacaacatgtggctgactccactgcaccgggctgttgcttccagaagtgaagaagcagtacaggttttgattaagcactcagctgatgtcaatgcaagggacaagaactggcagacccctcttcatgtggcagcagccaacaaggctgtcaaatgtgcagaagtgatcattcccctgctgagcagtgtcaatgtctccgaccgaggggggcgcacagccttgcaccatgcggctctgaacggccacgtggagatggtcaatttactcttgggccaaaggggcaaaatatcaatgcatttgacaagaaggaccggcgtgctctgcactgggcagcatacatgggccacttggatgttgtagcattgctcattaaccatggcgcagaagtgacctgtaaggataagaagggttatacccctctgcatgctgcagcctccaatggacagattaatgttgtcaagcatctcctgaacctgggggtggagattgatgaaatcaatgtctatggaaatacagcgcttcacatcgcctgctacaatggacaggatgctgtggttaacgagttgattgactacggtgctaacgtgaaccagccaaacaataatgggttcacccctttgcattttgctgctgcctccactcatggtgctttgtgtcttgaattgttagtaaacaacggggcagatgttaacattcagagtaaagatggcaaaagtccactgcacatgacagctgtccatggaaggttcacacggtcacagaccctcattcagaatggaggtgaaattgactgtgtggataaggacggcaacactcctctccatgtggctgcaagatacggtcatgagcttttgattaacaccttaataaccagcggagctgacacagccaagtgtggaatccatagcatgttccctttacatttagctgccctaaatgctcactctgactgctgcagaaagttgttatcatcgggacaaaagtatagcatagtatccttgtttagtaatgagcacgtgctgtctgcaggctttgaaatagacaccccagataaatttggaagaacgtgccttcatgctgctgctgcaggaggtaatgtggaatgtataaaactcttgcagagcagcggagcagatttccataaaaaggacaagtgtgggaggacccctttgcactatgcagctgcgaattgtcatttccactgtattgagacattagtgaccacaggggccaacgttaatgaaacagatgactggggacgcacagctttgcattacgccgctgcatcagacatggatagaaataagactatcttaggaaatgcccatgataattcagaagaacttgaaagagccagggagctgaaggaaaaggaagccacactatgtctagagtttctgcttcaaaatgatgcaaatccatctatccgggacaaggaaggttacaatagcatacattatgctgccgcctatgggcacaggcagtgtctggaattgcttttggaaagaacaaacagtggatttgaagaatcagattctggtgctactaagagtccactccacttagctgcctacaatgggcaccatcaagccttggaagtccttctgcagtcgttggtggacctggacatcagggatgagaaaggccgcactgctctggatctggctgcctttaaaggacacacagaatgtgtggaagcgcttatcaatcagggcgcatccatctttgtgaaagacaatgtaaccaaaagaaccccacttcatgcctcagtaattaatggtcacacactgtgtttacggctgttgctagaaattgcagacaacccggaggcggtcgatgtgaaagatgccaaaggacaaacaccactgatgcttgcagtagcatatggacatattgacgctgtttcattgttacttgaaaaggaagccaacgtagacactgttgacatcctaggatgcacagctttacacagagggattatgacaggacacgaggaatgtgtgcaaatgctgctggaacaagaagtgtcaattctctgtaaagattccagagggaggacgcccttgcactatgcagctgctcgtggccacgccacgtggctgagcgagctgctccaaatggctctttctgaggaggactgttgtttcaaagataaccaaggctacacgccgctgcactgggcttgttacaatggtaatgaaaactgtatagaggtacttttggagcaaaaatgttttcgcaaatttatcggtaatccctttactccactgcactgtgcaataatcaatgatcatgggaattgtgcatcattgctgcttggggccatagattccagtatcgtcagttgtagagatgacaaaggcaggacaccccttcatgcggcagcatttgctgatcatgtggagtgcttgcagcttcttctgagacacagtgctccagtgaacgcagtagataattcagggaaaacagcactgatgatggctgctgagaatgggcaggcaggcgctgtggatattttggtgaacagtgcccaggctgatctgactgtaaaggataaggacttgaatacacccttacatttggcttgtagtaaaggtcatgaaaaatgtgccttgttaatacttgacaagatacaagacgagagccttattaatgaaaaaaataatgcactgcagacacccctccacgtcgctgcgcgcaatggcttaaaggtggtagttgaggagttgctggccaaaggggcctgtgtacttgctgtagatgaaaatggtcataccccggccctggcttgcgctcctaacaaagacgtggctgactgcctggccctcattttggctaccatgatgcctttttctccttccagtacaatgatggctgtcaacttcg

SEQ ID NO: 305368 - DNA, 1008 bp, Homo sapiens
  misc_feature (546)..(546): n is a, c, g, or t
atctgtgcccggcggcgcaggacggcggtgggcggggctcacgcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtggggtngtctctcagtccatgggcaattttttttttcgagttggggtgggtacagaaaagtgtctttttgctatgccagaaatgcaataggactgttccctgaattgctggggggttgggggaaacggggtttcaaaaatttttttttcccctttttttttggggggcccccacccaaaaagcgggggggacaacaaacccgtttgtttttttcccccgccacgaattaaaataaaaaacaacaggggcgggggtggggggggagcataaataccatcatcgagtataacaaactttatagtgatatatatacatcaataaatagattagtatttagtaccaccgtagtgttactgtattttttttttacaaaacataggagggggagggggggaaggtataaacatggagggagaagcagactatatattgaacgtatgactatgattgattaattcgaagaaacgt

SEQ ID NO: 305369 - DNA, 759 bp, Homo sapiens
atctgtgcccggcggcgcaggacggcggtgggcggggctcacgcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggaagcctgagaattatattgctctagcacatcatttctgaaggcactggccatgttcttcagttctggggcttgtataggttggtataatgtttgtatatattcctcatatgtaacaaccaagaatatttatttcaaaagaaaagactgcagtgaaacagatcaagataatgttgtcttgaataaatgaagtaaagatgctgctgattcttcatact

SEQ ID NO: 305370 - DNA, 386 bp, Homo sapiens
agccagctaattaaacattttttgttgagacagagtttcaccaggctggtctcaaactcctggcctcaaggaatcctcccacctggtttctcaaagtgctgcgattacaggtttgagccaccatgcccagcctataatttctaatctaacattttgtaagaagcatggaaaacaagaataggaatttttgccttgaagctttgacattggactatggatctgtgactataatataatgtctgtggcaggggcaacttcaaaacttttaacaagtcattttagagtactcccttcccccagtatttaattttcataatacttttgatctagttgacaatgttgactattaaatctttttttttttatttgtaatctttccttcctag

SEQ ID NO: 305371 - DNA, 238 bp, Homo sapiens
gcagcgcgagatgtggaggctcatgtcgaggtgagtgagagagcgaggggccaagggcaggctcttcagcggcactcgccacagtgggaaaagggccgggggtggagactgctggcctcgaagtttcgagtcgcgctcagaggcgccgctgtgagaccccaaccttggccctccccaagccccagcccccgtccctgtctttcctttctccctctagcatcttctttgcagcagcact

SEQ ID NO: 305372 - DNA, 446 bp, Homo sapiens
ctgtcagtgacctctgcaaactctgcttttgttgtaggaagcagtacaggttttgattaagcactcagctgatgtcaatgcaagggacaagaactggcagacccctcttcatgtggcagcagccaacaaggctgtcaaatgtgcagaagtgatcattcccctgctgagcagtgtcaatgtctccgaccgaggggggcgcacagccttgcaccatgcggctctgaacggccacgtggaggtgggtatttttatcattcagaattggaacgctccctccaggactttcagccacaagtggaaactgatcttcttgctgagattttaaagaatgtgatgaaaatatttgtacaccaaaccttcagcatctatatcattctcaactttagagccacaatgaattgaaaaagtaggctgtcacttcagtcttttcctctgacacacatgac

SEQ ID NO: 305373 - DNA, 585 bp, Homo sapiens
ctgacaagcaggcattggctattgaagcaggggcctagtatcctgtttcttctgtagtttgctgacctatgccgattcaagacactttgtcccggaaatggaccactgtatgcgttattttctatactccatgaatatgattggtttgtaaggtgtgtattgattttatttaagtgtaattgctgtttgcttagccaattggcataatttatgctaagcaaactacaaatatggatttattttattagtcacagctacagaatttattccacttgtggaatgatgttttgtttttgtagcagattagaaaagttttgtttggtgctttggcaggattaagctagggtataatcttttatgagattttggcatattttaatattatttacatagacactctgcccatttattatagacaataaaggaactattggactaacagtagtaaattttttcctccaaaaggtaattaataaaatgtctccaacatctctaaagatcacactaaggcaactcatggaggggtcttcaaagaccttgcaagaagtactaactatggagtatcggctaagtcaagcttgtatg

SEQ ID NO: 305374 - DNA, 485 bp, Homo sapiens
atggtcaatttactcttgggccaaaggggcaaaatatcaatgcatttgacaagaaggaccggcgtgctctgcactgggcagcatacatgggtaaggattccatgcatggaaagcaaagtacagataaccttaactaaataagccatgggtctctcattgaccatgtaggttttctccagtctgacttcttttcaagcttgggttgcaattgaatgaagatttggttggttttactggcatgcatagtgcactccagtcgggcagttgctttgtcagatatttatttatcctacaaagaagaggaggaatgaatcatggcttgggcctctttgaatgtgcttcagtctggattggaaagctgcacagattgtgcttattttaacttgtcatggcagtaaaataaggtgttttaaaaagaaagagcactggctcggaaagcaaggacacaaattccattcgtctttttaaatttataaatatttttg

SEQ ID NO: 305375 - DNA, 951 bp, Homo sapiens
aaatgagtgagcaagaatgaatgccactcgcattggcatgtgagagctagaatgcctcactgttgcaattccagtaccacgggtgtgaaacaaagatcctctgtttctttggaaaatgacaccagattttatggagaactgaagtgttcctttatttaagtattagttcagtgtctgtaagattttttggcacctaatttaaacatctgatttaactgagattcttgtagccacagttatctcaaatgggagaagaagataactaaagcttgctggatgtgtaaagaagttcacctcactggggggttgggggggcagtgccagaagcagctgtagccaccaatgtcctcatgagtcctgcagaacatctgccaaatgtttcacggcggggggcgggtaaaatgttaatattaagcaaagtaatctagttagatcttcattagttttacttatttaggttattactcattttatgtagctaccaagctcagagctatagacaaccttcataaataaggccttcttttcctactagtcttttttatttgcaccttaatacagacgaaagaaaagaacttgaggccaaatggtatctcagggcacagtttggaataatttagtttgaaaagaaatattaatataaatctaagtatgatgattaaaaatgctctgtaaaccatctccagtaagagcattctagatgcggtcttcattagttatcatctttgtaagagtgataaatcacccgtgggtgtaccttgcaacttacctccagtgcagacatggcccatgcctattgctgtgcaacactataatcttgtctatggagttgattaaagagctttcagaaactcacataaaatgctgaactgaacatgattatcccagtcacttacagaaatgcactaataaaaccaatcagggtcttctcaccacccagggtacaagtcc

SEQ ID NO: 305376 - DNA, 5025 bp, Homo sapiens
  misc_feature (5)..(5): n is a, c, g, or t
  misc_feature (1728)..(1728): n is a, c, g, or t
  misc_feature (2424)..(2424): n is a, c, g, or t
  misc_feature (2427)..(2427): n is a, c, g, or t
ctganacccacttgtcccctggcagatgacatctgtgattactttggtgtgaaaattgccatgtacttcgcctggctgggcttctacacgtcggctatggtatacccagctgtcttcgggtctgtcctgtacacattcacagaggctgatcagacaagccgggatgtttcctgcgtggtctttgccctcttcaacgtgatctggtcgacgctgttcctagaggaatggaagcggagaggggctgagctggcatataagtgggggacgctggactcacctggggaagccgtggaggagccacgcccccagttcaggggcgtgcgacgtatcagccccatcacgcgggccgaggagttctactacccgccctggaagcggctgctcttccagctgcttgtgagcctccccctgtgcctggcgtgcctcgtctgtgtcttcttgctcatgcttggctgcttccagctgcaggagctggtgctgagcgtgaaggggttgccccgtctcgcccgattcctgcctaaggtcatgctggccctgcttgtcagtgtgagtgccgagggctacaagaagctagccatctggctcaatgacatggaaaattaccggctggagagcgcctatgagaagcacctcatcatcaaagttgtcctgttccagtttgtcaactcgtacctgagcctcttctacatcggtttctacctcaaggacatggagcgcttgaaagagctcctgctcgtcctgtccctgtcccagagcctcgagcggcagctgcaggcggtgctggtcccgctcgcggccctgcggttccgcctgctcctcctctccctccggggcctcctgctcgcggcccgggccaaaatgctggccacgctgctgatcacccgccagttcctccagaacgtgcgcgaggtcctgcagccgcacctgtaccggcgcctgggccgcggcgagctgggcctgcgggccgtctgggagctggcccgagccctgcttggcctcctgagcctccggcgccctgcgccccgccgcctcgaaccccaggcggatgagggcgggggcggcggcagcgggggcgggggccgcaggtgcctcagcgggggctgcggggcgccggaggaggaggaggaggcggcgctggtggagcggcggcgggcgggggaaggcggggaggagggggacgggcctccagggggcaaggaggaggacgaggacgacgaggaggaggaggacgaggaggaagaggaggacgaggaggagggcgaggaagggggcctcctggactgcgggctccggctgaagaaggtcagcttcgctgagcgcggcgcggggcggcgtcggcccggcccaagcccggaggccctcctggaggaagggagccccactatggtggagaaggggctggagccgggagtgttcaccctggccgaggaggacgacgaggcggagggggctcccggcagccctgaacgggagcccccggccatcttgttccgccgggccgggggcgagggccgagaccaggggcccgacgggggcccggacccggaacccggctccaacagcgattcgacccgtaggcagagacggcagaaccggtcgtcttggattgacccgccggaggaggaacactcgccccagctcacccaggcagagctggagagctgtatgaagaagtacgaggacacgttccaggactaccaggagatgttcgtgcagttcggctacgtngtgctcttctcgtccgccttccccctggcggcgctgtgcgccctggtcaacaacctcattgagatccgcagcgacgccttcaagctgtgcaccgggctgcagcggcccttcggccagcgcgtggaaagcatcggccagtggcagaaggtgatggaggccatgggtgtcctagcgattgtggtcaactgctacttaatcggccagtgcgggcagctgcagcgcctcttcccctggctgagcccggaggcagccatcgtgtcggtggtagtgctcgagcacttcgctctgctcctcaagtacctcatccacgtggccatccccgatatcccgggctgggtggccgaggaaatggccaagctggagtaccagcgccgcgaggcctttaagagacacgagcgccaggcccagcatcgctaccagcagcagcagcgcaggcggcgggaggaggaggagcgacagcgccatgcagagcaccatgcccggcgggagcatgattctggtggccgagaggaggcgagggccgagggctctgggctggaccctgccacctcctccgagaaggcctctgccaaggccaagggcagcactgcgggtggccacgggcctgaacggcccaagcgcccagggtccctgctggcacccaacaacgtcatgaagttgaagcagatcatcccactgcagggcaaattcctctcntcnggggccacatcctcactggctgctgcaggggccggagccaccacccggcctccccctgcccagtcacccacaggcagcgacacccgcctgcctgccttcctcagcttcaagttcctcaagtcacccgagacccggcgggactctgagcgcagccactcaccgcccaaagccttccatgctggcaagctcttcccctttggtggcacccgggctgagcctgggtccaacggggcgggcgggcaggcccggccagatgggacccccagcagtggcagcagccgggttcagaggagtgggccggtggacgaggccctggctgaggagctggaagccccccggcccgaagaggaaggctcaggtcacaagctttaactcgggggtggggacgccgggccggctttggggatagggtagggtggccaggcctggggagaggggctgaaggggacaggggaagcccggtcttaggtcctggtggggacctgggtcagtggtacgtggagcctctcagttaaagcctgcttagtatctccagggcctttgttagcctggagccccgtgcctgaccctccccagggagggatgccaaagccccttgtcccaggactgcacccagggacccccaccatgctccggtgccaggagagatgagggaggcctgtttcccaaccagcccacccttctcctgctccagctcactcttgggggggacttgaccccccaggcctctatgcaaatccacaccctgcagcccagctgttcaggaaggccttcctcgaggtggggctggggctgcccacccagggagctcccacatgtgctgagcagaggtgcaggcctcacccctaccctcccacccccaccacctcccctgccccaatcccagcctgggctccagcaaccccattcccagggagcccaacaggtggcagctgcagcacaagggccataggtcagaagccagagggacttcctcaaactgtcctccccctgtgaccggcaggggccgtgcccagaggcagggtatgcaccggaagccgcccagggggccgccccacctcagtctctgatcagaagcaataaggcctttatgtgcctggatgcccgggagggagcgcgggcagggttgccagcccggcggggtccggcgggggcggcatccccccggaacggcccctctcgcctccgcagggacagcgctggcccccgtgggcgcccctgccctccgcacccgccgcagccggagccccgcgccgccgccgccaatgccgctgccccggcccccgacaccgcccgccggctgctggcagtgggacgggccctggggctgcgggggcgagggtgccgccccccgccaggccctggccgctgccgagtgcccaccctgtgccatggccgggcccccacccgccccccagcccctgccgggagacgccagcttttacagcctcccgcccccaccgctaccgcccacctcggatcccctcgagaccccagcgccctcccctagccccagccccagcccccaggccgtgtgctggcccagcggctggcattagctctacccgccctgccttctcttctcatatgcaatatcagtcattcacaggggcggccggtctccaaaatgcaaaatgcgcttcagcccccgagggcccccagtattggtcggtgccccccatctgccgttttcctttccaaacgaaaggaaacccacaaatccaacagaaaacacacacacacacacacacacacacacacacacacacagaacaggcgattatttatttgtttttaatttattttgtcatatttttgtaaaacggcagaaatgcaataaaaactatatttcaacagtgcccgaggtcagagcagtggaaaagggagtgggggtgggggagtctgggtggctggggcctaggttgggaaccccctccccccatcctggtacaggctggcttgacccatgagggcctcctcccaaaaactgggtcttggccacagatggaaaactccaggctgcgccgcctctgagacggcccagatttggaggccaacttcagccctggcttcagccactagacaaaggaaggaatctctaagtgctgaaaagaggcgacaatgtgtgcacaggccccagtcctgagtaagactccttctcaaagaggacagcgcggtggtttgcaagacgtggccccttctggcacacccgcctcctggaacatcgtctggggagccagagacagtgggaagagcttgtggcatgaacatcagaaggcacctggcacctgagcctcctgcagtccccgacttgtgatactgagagaatggcacatttgggtgtccccaggacacggggtggcattgggatgcagcagggatgtcccactgtgggacagacatcagacccaagtcactgggactctgtcgtatgactcaggaacaggaacgtggcctctcagaccctcacatttttcaggaagaggacaaatgtgtccacatccaaaggcttaaggctcagagaccaacatggccatgctgcagggctgggccagtgtgagcaaggggccctttgggaggctgtggagaagtcagagt

SEQ ID NO: 305377 - DNA, 5223 bp, Homo sapiens
  misc_feature (5)..(5): n is a, c, g, or t
  misc_feature (1728)..(1728): n is a, c, g, or t
  misc_feature (2424)..(2424): n is a, c, g, or t
  misc_feature (2427)..(2427): n is a, c, g, or t
ctganacccacttgtcccctggcagatgacatctgtgattactttggtgtgaaaattgccatgtacttcgcctggctgggcttctacacgtcggctatggtatacccagctgtcttcgggtctgtcctgtacacattcacagaggctgatcagacaagccgggatgtttcctgcgtggtctttgccctcttcaacgtgatctggtcgacgctgttcctagaggaatggaagcggagaggggctgagctggcatataagtgggggacgctggactcacctggggaagccgtggaggagccacgcccccagttcaggggcgtgcgacgtatcagccccatcacgcgggccgaggagttctactacccgccctggaagcggctgctcttccagctgcttgtgagcctccccctgtgcctggcgtgcctcgtctgtgtcttcttgctcatgcttggctgcttccagctgcaggagctggtgctgagcgtgaaggggttgccccgtctcgcccgattcctgcctaaggtcatgctggccctgcttgtcagtgtgagtgccgagggctacaagaagctagccatctggctcaatgacatggaaaattaccggctggagagcgcctatgagaagcacctcatcatcaaagttgtcctgttccagtttgtcaactcgtacctgagcctcttctacatcggtttctacctcaaggacatggagcgcttgaaagagctcctgctcgtcctgtccctgtcccagagcctcgagcggcagctgcaggcggtgctggtcccgctcgcggccctgcggttccgcctgctcctcctctccctccggggcctcctgctcgcggcccgggccaaaatgctggccacgctgctgatcacccgccagttcctccagaacgtgcgcgaggtcctgcagccgcacctgtaccggcgcctgggccgcggcgagctgggcctgcgggccgtctgggagctggcccgagccctgcttggcctcctgagcctccggcgccctgcgccccgccgcctcgaaccccaggcggatgagggcgggggcggcggcagcgggggcgggggccgcaggtgcctcagcgggggctgcggggcgccggaggaggaggaggaggcggcgctggtggagcggcggcgggcgggggaaggcggggaggagggggacgggcctccagggggcaaggaggaggacgaggacgacgaggaggaggaggacgaggaggaagaggaggacgaggaggagggcgaggaagggggcctcctggactgcgggctccggctgaagaaggtcagcttcgctgagcgcggcgcggggcggcgtcggcccggcccaagcccggaggccctcctggaggaagggagccccactatggtggagaaggggctggagccgggagtgttcaccctggccgaggaggacgacgaggcggagggggctcccggcagccctgaacgggagcccccggccatcttgttccgccgggccgggggcgagggccgagaccaggggcccgacgggggcccggacccggaacccggctccaacagcgattcgacccgtaggcagagacggcagaaccggtcgtcttggattgacccgccggaggaggaacactcgccccagctcacccaggcagagctggagagctgtatgaagaagtacgaggacacgttccaggactaccaggagatgttcgtgcagttcggctacgtngtgctcttctcgtccgccttccccctggcggcgctgtgcgccctggtcaacaacctcattgagatccgcagcgacgccttcaagctgtgcaccgggctgcagcggcccttcggccagcgcgtggaaagcatcggccagtggcagaaggtgatggaggccatgggtgtcctagcgattgtggtcaactgctacttaatcggccagtgcgggcagctgcagcgcctcttcccctggctgagcccggaggcagccatcgtgtcggtggtagtgctcgagcacttcgctctgctcctcaagtacctcatccacgtggccatccccgatatcccgggctgggtggccgaggaaatggccaagctggagtaccagcgccgcgaggcctttaagagacacgagcgccaggcccagcatcgctaccagcagcagcagcgcaggcggcgggaggaggaggagcgacagcgccatgcagagcaccatgcccggcgggagcatgattctggtggccgagaggaggcgagggccgagggctctgggctggaccctgccacctcctccgagaaggcctctgccaaggccaagggcagcactgcgggtggccacgggcctgaacggcccaagcgcccagggtccctgctggcacccaacaacgtcatgaagttgaagcagatcatcccactgcagggcaaattcctctcntcnggggccacatcctcactggctgctgcaggggccggagccaccacccggcctccccctgcccagtcacccacaggcagcgacacccgcctgcctgccttcctcagcttcaagttcctcaagtcacccgagacccggcgggactctgagcgcagccactcaccgcccaaagccttccatgctggcaagctcttcccctttggtggcacccgggctgagcctgggtccaacggggcgggcgggcaggcccggccagatgggacccccagcagtggcagcagccgggttcagaggagtgggccggtggacgaggccctggctgaggagctggaagccccccggcccgaagaggaaggctcaggtcacaagctttaactcgggggtggggacgccgggccggctttggggatagggtagggtggccaggcctggggagaggggctgaaggggacaggggaagcccggtcttaggtcctggtggggacctgggtcagtggtacgtggagcctctcagttaaagcctgcttagtatctccagggcctttgttagcctggagccccgtgcctgaccctccccagggagggatgccaaagccccttgtcccaggactgcacccagggacccccaccatgctccggtgccaggagagatgagggaggcctgtttcccaaccagcccacccttctcctgctccagctcactcttgggggggacttgaccccccaggcctctatgcaaatccacaccctgcagcccagctgttcaggaaggccttcctcgaggtggggctggggctgcccacccagggagctcccacatgtgctgagcagaggtgcaggcctcacccctaccctcccacccccaccacctcccctgccccaatcccagcctgggctccagcaaccccattcccagggagcccaacaggtggcagctgcagcacaagggccataggtcagaagccagagggacttcctcaaactgtcctccccctgtgaccggcaggggccgtgcccagaggcagggtatgcaccggaagccgcccagggggccgccccacctcagtctctgatcagaagcaataaggcctttatgtgcctggatgcccgggagggagcgcgggcagggttgccagcccggcggggtccggcgggggcggcatccccccggaacggcccctctcgcctccgcagggacagcgctggcccccgtgggcgcccctgccctccgcacccgccgcagccggagccccgcgccgccgccgccaatgccgctgccccggcccccgacaccgcccgccggctgctggcagtgggacgggccctggggctgcgggggcgagggtgccgccccccgccaggccctggccgctgccgagtgcccaccctgtgccatggccgggcccccacccgccccccagcccctgccgggagacgccagcttttacagcctcccgcccccaccgctaccgcccacctcggatcccctcgagaccccagcgccctcccctagccccagccccagcccccaggccgtgtgctggcccagcggctggcattagctctacccgccctgccttctcttctcatatgcaatatcagtcattcacaggggcggccggtctccaaaatgcaaaatgcgcttcagcccccgagggcccccagtattggtcggtgccccccatctgccgttttcctttccaaacgaaaggaaacccacaaatccaacagaaaacacacacacacacacacacacacacacacacacacacagaacaggcgattatttatttgtttttaatttattttgtcatatttttgtaaaacggcagaaatgcaataaaaactatatttcaacagtgaaaaaaaaacaaaacaaaaaaaacacaacaaaaaccaaaaacaaagcagggcggcgcgcgccgcacaaaaagtaacccatccaggggcgacaccacactcccgcaacaccaaatcgcgagccaaacgcggggcccacaaagagagcgaggccgcataacaacacaaacagcccgcgcacgcgacaaccaacgccgccccaaccaccgagccacaccccacacaacgccacacccactcgacgcgccacgacaccaccacaccccccaccgcgaaccgaacaaccagccgcgcccaccacagccacacacaaaacagtaacacaccacccacacgaccacccaataaccaccgaccccaccccacacaaccaccggagcacgcacaccacaacgcgaacataacacgccgcgcccccgcccacaaaaagcatcagcgcaccaccaccgaaccacacaccaccaagacaacacaccaactaaaacagaccaggcgccccgccagaacgaaacagcccccgcccacgccacagccgccacaaacccagcaccccccgcagcaaccagacacccccacggccaacgcccacgcataaaccggcgaagacacagcgacgcagacgacgaagggaaaaacgcgaaagagacacgagagacgacacacacgagccacggccaaggcaccacgccacagaccaacgaccagcagagacgagaggacaaagcaacgagagaaacaaacgagagaagaaaggagcaggaagagagaagaactgaacgaaacaagcgacagacaaagaaaagaaggcacaaaaaagcgagaagagcgaagagaagcgaggcacggaagacgaaaaaggccgagagagaaagaaacagcagagaggcaccaccaacggaggccgatggacgcaggcgaacgaagaagaaaaggcgcagc

SEQ ID NO: 305378 - DNA, 4996 bp, Homo sapiens
  misc_feature (5)..(5): n is a, c, g, or t
  misc_feature (1728)..(1728): n is a, c, g, or t
  misc_feature (2424)..(2424): n is a, c, g, or t
  misc_feature (2427)..(2427): n is a, c, g, or t
ctganacccacttgtcccctggcagatgacatctgtgattactttggtgtgaaaattgccatgtacttcgcctggctgggcttctacacgtcggctatggtatacccagctgtcttcgggtctgtcctgtacacattcacagaggctgatcagacaagccgggatgtttcctgcgtggtctttgccctcttcaacgtgatctggtcgacgctgttcctagaggaatggaagcggagaggggctgagctggcatataagtgggggacgctggactcacctggggaagccgtggaggagccacgcccccagttcaggggcgtgcgacgtatcagccccatcacgcgggccgaggagttctactacccgccctggaagcggctgctcttccagctgcttgtgagcctccccctgtgcctggcgtgcctcgtctgtgtcttcttgctcatgcttggctgcttccagctgcaggagctggtgctgagcgtgaaggggttgccccgtctcgcccgattcctgcctaaggtcatgctggccctgcttgtcagtgtgagtgccgagggctacaagaagctagccatctggctcaatgacatggaaaattaccggctggagagcgcctatgagaagcacctcatcatcaaagttgtcctgttccagtttgtcaactcgtacctgagcctcttctacatcggtttctacctcaaggacatggagcgcttgaaagagctcctgctcgtcctgtccctgtcccagagcctcgagcggcagctgcaggcggtgctggtcccgctcgcggccctgcggttccgcctgctcctcctctccctccggggcctcctgctcgcggcccgggccaaaatgctggccacgctgctgatcacccgccagttcctccagaacgtgcgcgaggtcctgcagccgcacctgtaccggcgcctgggccgcggcgagctgggcctgcgggccgtctgggagctggcccgagccctgcttggcctcctgagcctccggcgccctgcgccccgccgcctcgaaccccaggcggatgagggcgggggcggcggcagcgggggcgggggccgcaggtgcctcagcgggggctgcggggcgccggaggaggaggaggaggcggcgctggtggagcggcggcgggcgggggaaggcggggaggagggggacgggcctccagggggcaaggaggaggacgaggacgacgaggaggaggaggacgaggaggaagaggaggacgaggaggagggcgaggaagggggcctcctggactgcgggctccggctgaagaaggtcagcttcgctgagcgcggcgcggggcggcgtcggcccggcccaagcccggaggccctcctggaggaagggagccccactatggtggagaaggggctggagccgggagtgttcaccctggccgaggaggacgacgaggcggagggggctcccggcagccctgaacgggagcccccggccatcttgttccgccgggccgggggcgagggccgagaccaggggcccgacgggggcccggacccggaacccggctccaacagcgattcgacccgtaggcagagacggcagaaccggtcgtcttggattgacccgccggaggaggaacactcgccccagctcacccaggcagagctggagagctgtatgaagaagtacgaggacacgttccaggactaccaggagatgttcgtgcagttcggctacgtngtgctcttctcgtccgccttccccctggcggcgctgtgcgccctggtcaacaacctcattgagatccgcagcgacgccttcaagctgtgcaccgggctgcagcggcccttcggccagcgcgtggaaagcatcggccagtggcagaaggtgatggaggccatgggtgtcctagcgattgtggtcaactgctacttaatcggccagtgcgggcagctgcagcgcctcttcccctggctgagcccggaggcagccatcgtgtcggtggtagtgctcgagcacttcgctctgctcctcaagtacctcatccacgtggccatccccgatatcccgggctgggtggccgaggaaatggccaagctggagtaccagcgccgcgaggcctttaagagacacgagcgccaggcccagcatcgctaccagcagcagcagcgcaggcggcgggaggaggaggagcgacagcgccatgcagagcaccatgcccggcgggagcatgattctggtggccgagaggaggcgagggccgagggctctgggctggaccctgccacctcctccgagaaggcctctgccaaggccaagggcagcactgcgggtggccacgggcctgaacggcccaagcgcccagggtccctgctggcacccaacaacgtcatgaagttgaagcagatcatcccactgcagggcaaattcctctcntcnggggccacatcctcactggctgctgcaggggccggagccaccacccggcctccccctgcccagtcacccacaggcagcgacacccgcctgcctgccttcctcagcttcaagttcctcaagtcacccgagacccggcgggactctgagcgcagccactcaccgcccaaagccttccatgctggcaagctcttcccctttggtggcacccgggctgagcctgggtccaacggggcgggcgggcaggcccggccagatgggacccccagcagtggcagcagccgggttcagaggagtgggccggtggacgaggccctggctgaggagctggaagccccccggcccgaagaggaaggctcaggtcacaagctttaactcgggggtggggacgccgggccggctttggggatagggtagggtggccaggcctggggagaggggctgaaggggacaggggaagcccggtcttaggtcctggtggggacctgggtcagtggtacgtggagcctctcagttaaagcctgcttagtatctccagggcctttgttagcctggagccccgtgcctgaccctccccagggagggatgccaaagccccttgtcccaggactgcacccagggacccccaccatgctccggtgccaggagagatgagggaggcctgtttcccaaccagcccacccttctcctgctccagctcactcttgggggggacttgaccccccaggcctctatgcaaatccacaccctgcagcccagctgttcaggaaggccttcctcgaggtggggctggggctgcccacccagggagctcccacatgtgctgagcagaggtgcaggcctcacccctaccctcccacccccaccacctcccctgccccaatcccagcctgggctccagcaaccccattcccagggagcccaacaggtggcagctgcagcacaagggccataggtcagaagccagagggacttcctcaaactgtcctccccctgtgaccggcaggggccgtgcccagaggcagggtatgcaccggaagccgcccagggggccgccccacctcagtctctgatcagaagcaataaggcctttatgtgcctggatgcccgggagggagcgcgggcagggttgccagcccggcggggtccggcgggggcggcatccccccggaacggcccctctcgcctccgcagggacagcgctggcccccgtgggcgcccctgccctccgcacccgccgcagccggagccccgcgccgccgccgccaatgccgctgccccggcccccgacaccgcccgccggctgctggcagtgggacgggccctggggctgcgggggcgagggtgccgccccccgccaggccctggccgctgccgagtgcccaccctgtgccatggccgggcccccacccgccccccagcccctgccgggagacgccagcttttacagcctcccgcccccaccgctaccgcccacctcggatcccctcgagaccccagcgccctcccctagccccagccccagcccccaggccgtgtgctggcccagcggctggcattagctctacccgccctgccttctcttctcatatgcaatatcagtcattcacaggggcggccggtctccaaaatgcaaaatgcgcttcagccccccatctgccgttttcctttccaaacgaaaggaaacccacaaatccaacagaaaacacacacacacacacacacacacacacacacacacacagaacaggcgattatttatttgtttttaatttattttgtcatatttttgtaaaacggcagaaatgcaataaaaactatatttcaacagtgcccgaggtcagagcagtggaaaagggagtgggggtgggggagtctgggtggctggggcctaggttgggaaccccctccccccatcctggtacaggctggcttgacccatgagggcctcctcccaaaaactgggtcttggccacagatggaaaactccaggctgcgccgcctctgagacggcccagatttggaggccaacttcagccctggcttcagccactagacaaaggaaggaatctctaagtgctgaaaagaggcgacaatgtgtgcacaggccccagtcctgagtaagactccttctcaaagaggacagcgcggtggtttgcaagacgtggccccttctggcacacccgcctcctggaacatcgtctggggagccagagacagtgggaagagcttgtggcatgaacatcagaaggcacctggcacctgagcctcctgcagtccccgacttgtgatactgagagaatggcacatttgggtgtccccaggacacggggtggcattgggatgcagcagggatgtcccactgtgggacagacatcagacccaagtcactgggactctgtcgtatgactcaggaacaggaacgtggcctctcagaccctcacatttttcaggaagaggacaaatgtgtccacatccaaaggcttaaggctcagagaccaacatggccatgctgcagggctgggccagtgtgagcaaggggccctttgggaggctgtggagaagtcagagt

SEQ ID NO: 305379 - DNA, 466 bp, Homo sapiens
  misc_feature (243)..(243): n is a, c, g, or t
aaagaggggctagccaggctaggcacaggtggaggggcggggatcacctgtgctcctccctccacagtcccggagctggcagcacgtgggatcatccagcaggtgttccctgtccacgagcagcgtattctgaaccgcctcatgaagtcatgggtgcaggccgtgtgtgaaaaccagcctctaggtgctgcctgggctggggggtgggagggagtcccagcagacaggcagggggtgactganacccacttgtcccctggcagatgacatctgtgattactttggtgtgaaaattgccatgtacttcgcctggctgggcttctacacgtcggctatggtatacccagctgtcttcgggtctgtcctgtacacattcacagaggctgatcaggtactgggcagggaccctgcaaggtctgggggatccagaggcgccctcctttctggactggcacaaacaatgact

SEQ ID NO: 305380 - DNA, 474 bp, Homo sapiens
ctaacccacatcaagccacaggagagtaagaaaaaactttgcttgtgttaagctactcagctatgggagtttatctgaagccctcgcacagcctagacagagcttcctacagtttcttcatttaacttcccagactattacctatcatccagactattccaactaaacacatgcaccaaaaggtgtgcccaaggctgttcactacaataccttttatttcaaaagttagaaacaaaacagttgaggccaggcacagtggctcacgcctataatcccagcacttttcagaggccgaggctggcagatcatgaggtcaggagatcgagaccatcctggccaacatggtgaaaccccgtctctactaaaaatacaaaaattagccaggtgaggtagcatgtgcctgtagtctgagctactcaagggtctaaggcgggagaaccgcctgaacccaggagccagaggttgcagtgagcc

SEQ ID NO: 305381 - DNA, 961 bp, Homo sapiens
atggagtttcactctgtcaaccaggctagagtgcagtggcacaatctcagctcactgcaccctccatctccaggttcaagtgattctcctacctcagcctcctaagtagctgggactacatgtgcatgccaccatgcctggctaatttttatatttttagtagagaaggggttttaccatgttggccaagctggtcttgaactcctgacctcaagtgatctgcccgcctcggcctgtaatccctttgggattccaaagtggtgggattacaggcatgagccactgcgcccagcctttttctcatatttcatattcataagtgctttcctgaaattagctaaaatttgtgcttattccattataacttgattaaaacttttttagtcctgagtagatgcacttctgtcttccttcccttctttgcccattgggaaatttctcaaaagtcttccttcataataattcaatatttatttatgtttgttactagtatttatttgcagataacctttgggaatattagacgtattagttattcatatgttggtactgtccttagatttttggagagagctttcttgccttcaacatctagctgagttttgtcccactgagagaatgggaaacttgactgaaatgatgggagagaatggattaattttggaacatggggcattatgggacatggtaggactgggacaggcctgatagaggctcctttatgtaatgtaagcatagcatgaggttgtaaggagacaatagataggaaggtgcagactggtgagatgagaaagtattaaaaacaacctttgaagtgatgagatgagaaagcattaaaaacaacctttgctttgcccttaggaataatgtgtattatttaaaaggtgtaagcactcattataatttgttgatgatagtttaagtatatggggtatgcccattagccattttctgttaaaaa

SEQ ID NO: 305382 - DNA, 1193 bp, Homo sapiens
tgtgactttaagtgaaatgacatacagcaggtccttgaataacattggttagttaaacatcatgtcattataaggttgattagaaaaaattgattttgttatacataattttgcttaaaatcacagtttccaagaacaacaatgttaagtgaggacttactgtaatttatgtctttggtaatcttaagtattatataagaaataaaaagtatttttgagagaacctaattggttgctgttattttctaaaacacaagccttagcttcatcacaaaaaagaaacctaagttaagaaaggtgtgtaaggtttcagatctcattttcatgtatgtatccatttaggccttctcaacacatccagaaaaggtatggaaagctaattcaagagtataggttgttttaatgtttgtagaaagcccggtgttaaccagtatagatttactcttgcagatacttcggtttacatcctttctagagatggataccaaagtggtgggattacaggcatgagccactgcgcccagcctttttctcatatttcatattcataagtgctttcctgaaattagctaaaatttgtgcttattccattataacttgattaaaacttttttagtcctgagtagatgcacttctgtcttccttcccttctttgcccattgggaaatttctcaaaagtcttccttcataataattcaatatttatttatgtttgttactagtatttatttgcagataacctttgggaatattagacgtattagttattcatatgttggtactgtccttagatttttggagagagctttcttgccttcaacatctagctgagttttgtcccactgagagaatgggaaacttgactgaaatgatgggagagaatggattaattttggaacatggggcattatgggacatggtaggactgggacaggcctgatagaggctcctttatgtaatgtaagcatagcatgaggttgtaaggagacaatagataggaaggtgcagactggtgagatgagaaagtattaaaaacaacctttgaagtgatgagatgagaaagcattaaaaacaacctttgctttgcccttaggaataatgtgtattatttaaaaggtgtaagcactcattataatttgttgatgatagtttaagtatatggggtatgcccattagccattttctgttaaaaa

SEQ ID NO: 305383 - DNA, 1489 bp, Homo sapiens
cggcttccgggatttggcggggcctttgtctctcgctgcagtcgcagctccaggtctcgtcttcactgctctatgtcctctgctcctagaggtccaccttctgtggccccgttacctgcaggccagaaaaactgggaaaatcacaggctcttccacttactggatgtttgacaaaatattcttcttgggccaaaaacattggcattactgggaccactgacatttagggatgtggccatagaattctctctggaggagtggcaatgcctggacacttcacagcagaatttgtataggaatgtgatgttagataactacagaaacctggtcttcctgggtattgctgtctctaagccagacctgatcacttgtctggagcaaggaaaagagccctgcaatatgaagagacatgcgatggtagccaaacccccaggttggagtgcagtggcgtgatcttgggttactgcaacctctgcccctcgggattcaagtgattctactgcctcagcctcccgagtagctgggattataggcgagtgccatcatgcccggctaatttttgtatttttagtagagtgagggtttcaccatgttggccaggctggtctcgaacgcctgacctcgtgtgatccgccctcctcagcctcccaaagtgctgggattacaggcatgagccacagtgcccggccaagtatttttatatttcagatcatatctactgaatgatttggtgacagaaatttgcattgcttttacctattggctttcagtaacaatggtataataattatgggtatgaaaatgactcttcatatgaccacatatgtgaaagtatatatatgtgctgcattctattttactagtctcctttttttttttacctttatacttgtagcaaattgttttaattctgtagctttgtaatatgttttaaaatcagaaactataatgcttccaacattgttcctttttttgaagattgttaggtactttattgtctcttgagattccatatactttaggggttgctgtttttatgtcttcaaaaatgcaatgagaaattgagaaaacattgcattaaatcttgtagattacattgagcagtatagacatcttcccaatatttcaacttttgaacaaaagcatgctaaagaatgtggtttaatttactatatatttgtaaacttgttagcttttaatattgttttatattgtcattccatttttgttatagaaagtaatccataaaatttcagttctaaaatactttttaagactcttttgacttatttggtggtctgtcaagaagaaagttgtataagctattgataagggtgtgtatcttaatgttgttgagttttgtatacctatgttaggaatatttgttttatactgccttcaggtcctctgttctcttactaatgttctgtcttgttttattcttactatagaaaatgggatattaaaatagtctataattatattgttc

SEQ ID NO: 305384 - DNA, 1231 bp, Homo sapiens
cggcttccgggatttggcggggcctttgtctctcgctgcagtcgcagctccaggtctcgtcttcactgctctatgtcctctgctcctagaggtccaccttctgtggccccgttacctgcaggtattgggagatccacagctaagacgccaggactccctggaagcctagaaatgggaccactgacatttagggatgtggccatagaattctctctggaggagtggcaatgcctggacacttcacagcagaatttgtataggaatgtgatgttagataactacagaaacctggtcttcctgggtattgctgtctctaagccagacctgatcacttgtctggagcaaggaaaagagccctgcaatatgaagagacatgcgatggtagccaaacccccaggttggagtgcagtggcgtgatcttgggttactgcaacctctgcccctcgggattcaagtgattctactgcctcagcctcccgagtagctgggattataggcgagtgccatcatgcccggctaatttttgtatttttagtagagtgagggtttcaccatgttggccaggctggtctcgaacgcctgacctcgtgtgatccgccctcctcagcctcccaaagtgctgggattacaggcatgagccacagtgcccggccaagtatttttatatttcagatcatatctactgaatgatttggtgacagaaatttgcattgcttttacctattggctttcagtaacaatggtataataattatgggtatgaaaatgactcttcatatgaccacatatgtgaaagtatatatatgtgctgcattctattttactagtctcctttttttttttacctttatacttgtagcaaattgttttaattctgtagctttgtaatatgttttaaaatcagaaactataatgcttccaacattgttcctttttttgaagattgttaggtactttattgtctcttgagattccatatactttaggggttgctgtttttatgtcttcaaaaatgcaatgagaaattgagaaaacattgcattaaatcttgtagattacattgagcagtatagacatcttcccaatatttcaacttttgaacaaaagcatgctaaagaatgtggtttaatttactatatatttgtaaacttgttagcttttaatattgttttatattgtcattccatttttgttatagaaagtaatccataaaatttcagttctaaaatac

SEQ ID NO: 305385 - DNA, 966 bp, Homo sapiens
gtggtattttgctataccatcttccttatgtagtttgtatatttttataggttagatttgtaaagtatattcatctgagtctagtaagtggggtaattgttacttttatttctttcagttgtgtgttctcattttgcccaagacctttggccaaagcagggcttaaaagattcttttcaaaaagtgatactgagaagatatggaaaatatggacatgagaatttacaattaagaaaaggctgtaaaagtgcggatgagcataaggtgcacaaaagaggttataatggacttaaccaatgtttgacaactacccagagcaaaatatttcaatgtgataaatatgttaaagtccttcataaattctcaaattcaaatatacataagaaaagacaaactggaaagaaacctttcaaatgtaaagaatgtggcaaatcatgttgcatactttcacaactaactcagcataagaaaactgctactagagtgaatttctacaaatgtaagacatgtggaaaagcctttaaccagttctcaaatcttactaaacataagataattcatcctgaagtgaatccctacaaatgtgaagaatgtggcaaagcctttaaccagtccttaactcttactaaacataaaaaaattcatactgaagagaaaccttacaaatgtgaagattgtggcaaagtctttagtgtattttcagtccttactaaacataagataattcatacaggaacaaaaccctacaattgtgaagaatgtggcaaaggctttagtatattctcaacccttactaaacataagataattcatactggagagaaaccctacaaatgcaatgaatgtggtaaagcctttaactggtcctcaactcttactaaacataagagattcatactggagagagaccctacaaatgtgaagaatgtggcaaagctttaaccagtcctcaacccttactagaca

SEQ ID NO: 305386 - DNA, 1316 bp, Homo sapiens
cggcttccgggatttggcggggcctttgtctctcgctgcagtcgcagctccaggtctcgtcttcactgctctatgtcctctgctcctagaggtccaccttctgtggccccgttacctgcaggtattgggagatccacagctaagacgccaggactccctggaagcctagaaatgggaccactgacatttagggatgtggccatagaattctctctggaggagtggcaatgcctggacacttcacagcagaatttgtataggaatgtgatgttagataactacagaaacctggtcttcctgggtattgctgtctctaagccagacctgatcacttgtctggagcaaggaaaagagccctgcaatatgaagagacatgcgatggtagccaaacccccaggttggagtgcagtggcgtgatcttgggttactgcaacctctgcccctcgggattcaagtgattctactgcctcagcctcccgatgctgggattacaggcatgagccacagtgcccggccaagtatttttatatttcagatcatatctactgaatgatttggtgacagaaatttgcattgcttttacctattggctttcagtaacaatggtataataattatgggtatgaaaatgactcttcatatgaccacatatgtgaaagtatatatatgtgctgcattctattttactagtctcctttttttttttacctttatacttgtagcaaattgttttaattctgtagctttgtaatatgttttaaaatcagaaactataatgcttccaacattgttcctttttttgaagattgttaggtactttattgtctcttgagattccatatactttaggggttgctgtttttatgtcttcaaaaatgcaatgagaaattgagaaaacattgcattaaatcttgtagattacattgagcagtatagacatcttcccaatatttcaacttttgaacaaaagcatgctaaagaatgtggtttaatttactatatatttgtaaacttgttagcttttaatattgttttatattgtcattccatttttgttatagaaagtaatccataaaatttcagttctaaaatactttttaagactcttttgacttatttggtggtctgtcaagaagaaagttgtataagctattgataagggtgtgtatcttaatgttgttgagttttgtatacctatgttaggaatatttgttttatactgccttcaggtcctctgttctcttactaatgttctgtcttgttttattcttactatagaaaatgggatattaaaatagtctataattatattgttc

SEQ ID NO: 305387 - DNA, 1334 bp, Homo sapiens
cggcttccgggatttggcggggcctttgtctctcgctgcagtcgcagctccaggtctcgtcttcactgctctatgtcctctgctcctagaggtccaccttctgtggccccgttacctgcaggtattgggagatccacagctaagacgccaggactccctggaagcctagaaatggccagaaaaactgggaaaatcacaggctcttccacttactggatgtttgacaaaatattcttcttgggccaaaaacattggcattactgggaccactgacatttagggatgtggccatagaattctctctggaggagtggcaatgcctggacacttcacagcagaatttgtataggaatgtgatgttagataactacagaaacctggtcttcctgggtattgctgtctctaagccagacctgatcacttgtctggagcaaggaaaagagccctgcaatatgaagagacatgcgatggtagccaaacccccagttgtgtgttctcattttgcccaagacctttggccaaagcagggcttaaaagattcttttcaaaaagtgatactgagaagatatggaaaatatggacatgagaatttacaattaagaaaaggctgtaaaagtgcggatgagcataaggtgcacaaaagaggttataatggacttaaccaatgtttgacaactacccagagcaaaatatttcaatgtgataaatatgttaaagtccttcataaattctcaaattcaaatatacataagaaaagacaaactggaaagaaacctttcaaatgtaaagaatgtggcaaatcatgttgcatactttcacaactaactcagcataagaaaactgctactagagtgaatttctacaaatgtaagacatgtggaaaagcctttaaccagttctcaaatcttactaaacataagataattcatcctgaagtgaatccctacaaatgtgaagaatgtggcaaagcctttaaccagtccttaactcttactaaacataaaaaaattcatactgaagagaaaccttacaaatgtgaagattgtggcaaagtctttagtgtattttcagtccttactaaacataagataattcatacaggaacaaaaccctacaattgtgaagaatgtggcaaaggctttagtatattctcaacccttactaaacataagataattcatactggagagaaaccctacaaatgcaatgaatgtggtaaagcctttaactggtcctcaactcttactaaacataagagattcatactggagagagaccctacaaatgtgaagaatgtggcaaagctttaaccagtcctcaacccttactagaca

SEQ ID NO: 305388 - DNA, 1960 bp, Homo sapiens
accctctcttctccctggtcaaccgctctgcaaacaaccatcaatctgatcccacaggcctgagaaagtctgctctccagtacctgctgctgatctgtttcagccgacaagaggcaccatgaaattggaattcacggagaaaaactacaatagcttcgtgctgcagaacctgaacagacagaggaaacgcaaagagtactgggacatggccctgagtgtggacaaccacgtcttctttgcacatcgcaatgtgctggctgctgtctccccactggtgaggagcctcatctccagcaatgacatgaagaccgctgatgagcttttcatcaccattgacaccagttacctgagcccggtcacagtggaccagcttctggactacttctatagcggcaaggtggtgatctccgagcaaaatgtggaggagctgcttcgtggggctcagtatttcaacacaccacgccttcgagttcactgtaacgacttccttattaagtccatctgccgtgccaactgcttgcgctacctcttcttggctgagctgtttgagctcaaagaggtatcagacgtagcttactctggcattcgggacaacttccactactgggccagtcctgagggctccatgcacttcatgcgctgtccacctgttatctttggccgcctgctccgtgatgaaaaccttcacgtgctcaatgaagaccaggcgctcagcgcactcatcaattgggtgtacttccggaaggaggatcgggagaagtatttcaagaagttcttcaattacatcaatctcaatgctgtctccaataagacgctggtgtttgccagcaacaagctggtgggcatggagaacacctcatcccatacaaccctgattgagagtgtcctgatggaccgcaagcaggagcggccatgcagcctgctggtctaccagcggaaaggggccctgcttgattccgtggtcatcctcggtggccagaaggcccacggccagttcaatgatggagtgtttgcttatatcatccaggagaacctgtggatgaagctctcagacatgccctatcgggcagcagcacttagtgccacctctgctggtcgctacatctacatctctggtggcaccactgagcagatttcagggctgaagacagcctggcggtatgacatggatgacaactcctggaccaagttgcctgacctgcccatcgggcttgtcttccacaccatggtgacctgtggggggacagtgtactcagtgggcgggagcattgccccaaggcggtatgtctccaacatctatcgctatgatgagcggaaggaagtctggtgcctggcaggaaagatgagcatccccatggatggcaccgccgtgatcactaaaggagacaggcatctgtacattgtcactggacggtgcttggtgaaaggttatatctcccgggtcggggtagtggactgctttgacaccagcactggggacgtggtccagtgtatcaccttccccattgagttcaaccatcggcccctgctctctttccaacaggacaacatcctctgcgtgcacagccaccggcagagtgtggaaatcaatctgcagaaggtgaaggcaagcaagacgaccacctcagtgcctgtcttgcccaacagctgccccttggatgtgtcccatgctatatgctccattggagacagcaaggtgtttgtatgtgggggtgtcaccactgccagcgatgtccagacaaaggactacaccatcaatccaaatgccttcttgctggaccaaaagacaggcaagtggaagaccctggctcctccaccagaggcactggactgtcctgcctgctgtctagccaagctaccttgcaagattcttcaaaggatttaaacattttaagtgggagaataagtaaatgcattattattcacgatttaatgagagaaagagaggaagatggcctgt

SEQ ID NO: 305389 - DNA, 1294 bp, Homo sapiens
  misc_feature (1)..(1): n is a, c, g, or t
ngtcggaaatttttcgcaatggcaaaattgaaagcttgcttgaagcaagccatccacaggagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaaaccacagcttttggaccctaaaaggtctggattgatcgtactgctttctgaaagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagca

SEQ ID NO: 305390 - DNA, 1008 bp, Homo sapiens
cgccgccgctgccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgccatgcagttgtggtcagctcctgacacacttggatagcacccagcagatgatgctaattccttgaaggacaataccaccttcttgacccaggtgcagaaagcatgggtgaaaagctggcacagttgagggcgaacttgccagcatggatgaccggtgagaagtgcgaaagtggcccttgggagctgggacacggggtatccctaaccctgtgaaacctggtacaacggtacaacgggtcccgttatataactagagtccccgccagtggaagggggaaagagacatgcaggggggaacaccctcggagaaaaggggcgacgagggggcacaaaaggggcggcacacaggagaaaggcgggcacaggaaacagcaaggcgacgagag

SEQ ID NO: 305391 - DNA, 642 bp, Homo sapiens
gagcatcagagcaagtaccatggcaatacatgatttgtgggtcctctaaaaggttttgttgttaacatgcaagcaaacagcactgaacaataaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaataaaaaatgctcgtcaaagttctttctctttaaatagtaacattctgtttcagtaggaacataatgaaaggaatcttttaaatggaagagcggaattataatgtttgtattccctgtaataactataaatcagttactttatttctaagattgagttattgttgcagatgtttagggaaagctaaaagccccttccttcccctcctgtgtgtaaataaaatacttttgagatcaaaaaatga

SEQ ID NO: 305392 - DNA, 3737 bp, Homo sapiens
cgccgccgctgccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaataaaaaatgctcgtcaaagttctttctctttaaatagtaacattctgtttcagtaggaacataatgaaaggaatcttttaaatggaagagcggaattataatgtttgtattccctgtaataactataaatcagttactttatttctaagattgagttattgttgcagatgtttagggaaagctaaaagccccttccttcccctcctgtgtgtaaataaaatacttttgagatcaaaaaatga

SEQ ID NO: 305393 - DNA, 3686 bp, Homo sapiens
ccccaaacatatgtctaggtcgaggcccgggtgtaaatcggccgagggcaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaataaaaaatgctcgtcaaagttctttctctttaaatagtaacattctgtttcagtaggaacataatgaaaggaatcttttaaatggaagagcggaattataatgtttgtattccctgtaataactataaatcagttactttatttctaagattgagttattgttgcagatgtttagggaaagctaaaagccccttccttcccctcctgtgtgtaaataaaatacttttgagatcaaaaaatga

SEQ ID NO: 305394 - DNA, 3497 bp, Homo sapiens
cgccgccgctgccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaata

SEQ ID NO: 305395 - DNA, 3554 bp, Homo sapiens
cgccgccgctgccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaaaccacagcttttggaccctaaaaggtctggattgatcgtactgctttctgaaagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaata

SEQ ID NO: 305396 - DNA, 3314 bp, Homo sapiens
cgccgccgctgccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaata

SEQ ID NO: 305397 - DNA, 3443 bp, Homo sapiens
cgccgccgctgccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaacttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaata

SEQ ID NO: 305398 - DNA, 3500 bp, Homo sapiens
cgccgccgctgccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaaaccacagcttttggaccctaaaaggtctggattgatcgtactgctttctgaaagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaata

SEQ ID NO: 305399 - DNA, 2483 bp, Homo sapiens
  misc_feature (1)..(1): n is a, c, g, or t
ngtcggaaatttttcgcaatggcaaaattgaaagcttgcttgaagcaagccatccacaggagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaaaccacagcttttggaccctaaaaggtctggattgatcgtactgctttctgaaagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaata

SEQ ID NO: 305400 - DNA, 2308 bp, Homo sapiens
cgccgccgctgccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagca

SEQ ID NO: 305401 - DNA, 2072 bp, Homo sapiens
ctcccaagtatcggcctatcccccctcgaggatttcgcggtggattcagaggaggtcgtgggggccgggagtttgcggattttgaatataggaaaaccacagcttttggaccctaaaaggtctggattgatcgtactgctttctgaaagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaata

SEQ ID NO: 305402 - DNA, 2159 bp, Homo sapiens
tggggttcaccactgcattaacctctactgactggaagatgcagtcaacaatgaggtactactgagtatggaagttatagaaggagtttcgtggaaatgagtgagacaggtttttctatgaaagtaaaagtgggggagtatatttaaagataatttaaaataaacttgagcaaagtaaaaagaaaataatacaccaataatttggaacatgagctaaatttttttttcttttttagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaata

SEQ ID NO: 305403 - DNA, 2209 bp, Homo sapiens
cgccgccgctgccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtagaacacttgtttttacaatgccccgggttgtggggggtttcccacatatgcgcctcgtggaggacaacccctctttattttcccttgtggggatctacaagcagtgttccatccaagaatggccattgttcatgtcatccccatcttacgtttctattaccggctggtttc

SEQ ID NO: 305404 - DNA, 2042 bp, Homo sapiens
cgccgccgctgccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaaaccacagcttttggaccctaaaaggtctggattgatcgtactgctttctgaaaggtaaaaaaaacaaatactttgggaggtgtgaaggttggctttgtgggggacagcaggttcatcttgtagctcattgctgtcaacttatgccataccatatgtatttcagtttaataacggggtgcaaatgttttggtgttgtatacacagatgaagttaagtctcacctaggaaatgtctgtttctaacagttggggtgagaatcagcagtaaaaaccaggtatatggtagcagctggtctagaggaaaataaaagcccttggctccagccctttgtacaggcctttagtttagggtcagtctctctggaaatcttgagatttttattgcttcctcactggttactttttaaaaattccccagttcagctttctacttttcagagcttatttcagatttaagagttatcct

SEQ ID NO: 305405 - DNA, 1614 bp, Homo sapiens
cgccgccgctgccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatatagggtaagtgttactgttaataaattctttggggttgacatgc

SEQ ID NO: 305406 - DNA, 1483 bp, Homo sapiens
cgccgccgctgccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaataaaaaatgctcgtcaaagttctttctctttaaatagtaacattctgtttcagtaggaacataatgaaaggaatcttttaaatggaagagcggaattataatgtttgtattccctgtaataactataaatcagttactttatttctaagattgagttattgttgcagatgtttagggaaagctaaaagccccttccttcccctcctgtgtgtaaataaaatacttttgagatcaaaaaatga

SEQ ID NO: 305407 - DNA, 1720 bp, Homo sapiens
cgccgccgctgccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagacgaacggagaccaacccttcgctgacgccataaaactcttcaccaaagagcccctaaaacccgccacatctaccatcagcctctacatcaccggccccgaccttaggcgtctcaccatcggctctctctaactcatgaaacccagcgcctggcgcattagcccaaacgcaccggcggaaactacaaccgcgagggggcgcccatacacaatacctacgctccagcgcatataggcgctaggcgcggccgaacgagcaacacgtccagaatccaggggccgccggcactccaagcgccaagagcgcgagcgccagcaggacacgcgccggcacaagggaaagcaggcacgacccgagcccacagcccgcgggcacacg

SEQ ID NO: 305408 - DNA, 1243 bp, Homo sapiens
cgccgccgctgccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaata

SEQ ID NO: 305409 - DNA, 1088 bp, Homo sapiens
cgccgccgctgccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcttccaaaatgctgggctttacaggtgtgagctactgcgccaggctaataatcttgggttgcgagacacgagtctggccctccagccgggcggcacagaggtgagacatccgtctcgacgagtctacgtgaccgccacacggggtggcccacgcaaagggccggccaatctctacgggaaggccgcacaaatctgcggccccaattgagggccaaaacctaaggggcaggccccaataagaacccaagaggacaagcacacgcccgggcgac

SEQ ID NO: 305410 - DNA, 257 bp, Homo sapiens
gaacacaacctcataatacagatagtcttttatattgcatatatttaacttcgggcaaaagccactctattttcctctttaaaaaaacttttttagctatagattaatgaatactttctcagacatttcagaactactgcttagtacttgaaatacaacatttagaatctggggtactacctgaatgtgatgagtagtcacacatctcatatcctttgttttcttgccagttcgatcctttggtacagaagacagac

SEQ ID NO: 305411 - DNA, 269 bp, Homo sapiens
ctgcctttacacaggatacaagatctctaaaaacacagttatctcaaggtaagctatctcatccctaaaatatttccattctaaacttttatagtggtttttgtctttctgaatgtaagagcttttgcagcttgtaaatcgcgtgtataatttctatttggctcttttaaaatttttctccaaatcgctgtattgcaatgaatatattattgaatgactctcactatttagacttattacagttcttagatcatgaaactgaaatgctg

SEQ ID NO: 305412 - DNA, 302 bp, Homo sapiens
ccgagatcttgccactgcactccagcctgggtgacagagcaagactgtgtctcaaaaacacaaacaaacagaaaagaatataacaaataagatgcacaccacacttgactgttcatagtagttattctgtgacatgagattggagttgattgaagggtgagacagtatgggggactttcctttaacatttaaatagtcttaaacactttacaatgagagttattaattttaaaattaaaaataggcacaatggctcacgtctgtaatctcagcactttgggaggccaagacaggaggatcac

SEQ ID NO: 305413 - DNA, 1283 bp, Homo sapiens
agcggagaaacgcccggcctgccgcggcggcgcgaggggcgggctttcaggctcccggcggctgcttgcgccccagcgcgcgcccaggcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggaggctggctgggccgcaacttgccaaaccctgatctagagagctatgcccttttcatatctagccttcagaatataaaattcaacaaacttattttcaagatacaacttttaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaagg

SEQ ID NO: 305414 - DNA, 427 bp, Homo sapiens
  misc_feature (30)..(30): n is a, c, g, or t
  misc_feature (48)..(48): n is a, c, g, or t
  misc_feature (51)..(52): n is a, c, g, or t
caggtcgaaggatggcacggtaagcaagcncaatgcaaaaaacaaaanaannggttagggttttccgaaattctctgtatgcaccagattattcatctcgtttagatattgtaagagcaaattcaaagtcacctcttcagagatcactgtcagctaagtgtgtatctggaacaggacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaagg

SEQ ID NO: 305415 - DNA, 2737 bp, Homo sapiens
agcggagaaacgcccggcctgccgcggcggcgcgaggggcgggctttcaggctcccggcggctgcttgcgccccagcgcgcgcccaggcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaaggctttaaaaaatattgcataccagtcatttcaacatcctacctagtgttacatgatttttgtgtaagtgcctttttttttaaagatggtgtatttcaaagtatttcatattaatgtactatatctacttgaagttccaatagtacattatgacagaaaccaaaagatctaacaattctgcttagctttttggttaagactccatgctttcattaccagaaaagggtcttacgtagtcattatgattcatggaattctattccatgaagccttaagaaaaaaaactttttttaactttccctgaaactttatcatttgataagtaaatttacttttcaagaagagtataaccaaagagtaaagataatgtgacactaagttatcaatgttttatgaatacacataaggcataaatttcagctgtaaaaaagctacattcaatctgactctggttttaaaacaaaactgctgtcataattatacatgatactgcaacttttggaaggctaatttggtggaatgttgcctcatcatagaacaccatagatcattaaaaattctataaaaattttaccaagctaccatatagttaataaaagggtatacagtcacttttatttctgaaaatataaaacattgagcctttcagtgtatctgatgcttctcttttggtaaggaatacttttatttcatggatcccaggcaggcatataaaagttacggaatttataaaatcatttgggataattagaaaatgcaattattcataacagaaaaataaagactttctagaaagcttctgactttgtcaatcatggctctgttcttaacaaagcactccttcctgagaatagtcctaagtgacaaagttgtttcagtacttttttgtaaaatatttaaaacattttaaaaccctaaattgatattcttaagaaactcaagatatcattggatatttactgcttcctcactcagtatttaaatttggttgtacttcgggggaaaacaacagagttattattttgctgcttactaaatagcaacttctcttgagcattatttgccttgtttgtaaagttaaaactgcgtaaaacagtaattctggaataaaacatacattctgcctacctcaaagaaatattctaagaacaaaaggaatactatccatgaaaatactttcattaatgtaaaattttcattatttagaccagcctaggttggcaaacttcttaaagggccagatagcaaatactgttattcttcgtgggtttaggcaaattcaagactattatacaggtaactatgtaaccatgtaagacttaagtacacttaaaaaatgtgaaaaaccattcctagcttccactacaacaacaacaaaaaacaggcaaccaatccaaccaacccagcctgtaagtctccatctcttatctccaaaataggaatacaaattgagtatcctttatctgaagtgcttgggaccagaagtatttaagactttggatttcttcagattttggagtatttgcattataccagttcaacattcctaacccaaaaatctgaaatctta

SEQ ID NO: 305416 - DNA, 3468 bp, Homo sapiens
agcggagaaacgcccggcctgccgcggcggcgcgaggggcgggctttcaggctcccggcggctgcttgcgccccagcgcgcgcccaggcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggtgagcaagaaaccgtactctaaaggaatttgagctgctgcctttggaattgttgagttctaaaaatgtttcccctcagtcatatcacctcggtaacttatcctcccctggacctatttcttctcttctataaaatgacagaagattgcattaagtgcagctctattatttcttaattatcttttatactgtaattacatattactctctaaagcataacacttgagagcagaagtggaaaagacaaaagaatgctaatgcagatgtgttatctgctataatatgaagagcagattctgaagtccaacttaggtttaaatctcactatcaaaacttagtggatctcattaaattataaagttaaataccaaattatactaaaaaagggcttttactgaacacagaaatcatttcattttttttctatatccagaaagcttgagtttcccagtatctagagcaggggctgacaaactttttctttaagatgtggagactaacattcttaggctttgtgggccatatggtttctaccccaacaactataaataacaactgttaagtaacacataaagcagtatgactgtgttctaataaaattctatttacaaaagcaggaggctggctgggccgcaacttgccaaaccctgatctagagagctatgcccttttcatatctagccttcagaatataaaattcaacaaacttattttcaagatacaacttttaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaaggctttaaaaaatattgcataccagtcatttcaacatcctacctagtgttacatgatttttgtgtaagtgcctttttttttaaagatggtgtatttcaaagtatttcatattaatgtactatatctacttgaagttccaatagtacattatgacagaaaccaaaagatctaacaattctgcttagctttttggttaagactccatgctttcattaccagaaaagggtcttacgtagtcattatgattcatggaattctattccatgaagccttaagaaaaaaaactttttttaactttccctgaaactttatcatttgataagtaaatttacttttcaagaagagtataaccaaagagtaaagataatgtgacactaagttatcaatgttttatgaatacacataaggcataaatttcagctgtaaaaaagctacattcaatctgactctggttttaaaacaaaactgctgtcataattatacatgatactgcaacttttggaaggctaatttggtggaatgttgcctcatcatagaacaccatagatcattaaaaattctataaaaattttaccaagctaccatatagttaataaaagggtatacagtcacttttatttctgaaaatataaaacattgagcctttcagtgtatctgatgcttctcttttggtaaggaatacttttatttcatggatcccaggcaggcatataaaagttacggaatttataaaatcatttgggataattagaaaatgcaattattcataacagaaaaataaagactttctagaaagcttctgactttgtcaatcatggctctgttcttaacaaagcactccttcctgagaatagtcctaagtgacaaagttgtttcagtacttttttgtaaaatatttaaaacattttaaaaccctaaattgatattcttaagaaactcaagatatcattggatatttactgcttcctcactcagtatttaaatttggttgtacttcgggggaaaacaacagagttattattttgctgcttactaaatagcaacttctcttgagcattatttgccttgtttgtaaagttaaaactgcgtaaaacagtaattctggaataaaacatacattctgcctacctcaaagaaatattctaagaacaaaaggaatactatccatgaaaatactttcattaatgtaaaattttcattatttagaccagcctaggttggcaaacttcttaaagggccagatagcaaatactgttattcttcgtgggtttaggcaaattcaagactattatacaggtaactatgtaaccatgtaagacttaagtacacttaaaaaatgtgaaaaaccattcctagcttccactacaacaacaacaaaaaacaggcaaccaatccaaccaacccagcctgtaagtctccatctcttatctccaaaataggaatacaaattgagtatcctttatctgaagtgcttgggaccagaagtatttaagactttggatttcttcagattttggagtatttgcattataccagttcaacattcctaacccaaaaatctgaaatctta

SEQ ID NO: 305417 - DNA, 2851 bp, Homo sapiens
agcggagaaacgcccggcctgccgcggcggcgcgaggggcgggctttcaggctcccggcggctgcttgcgccccagcgcgcgcccaggcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggaggctggctgggccgcaacttgccaaaccctgatctagagagctatgcccttttcatatctagccttcagaatataaaattcaacaaacttattttcaagatacaacttttaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaaggctttaaaaaatattgcataccagtcatttcaacatcctacctagtgttacatgatttttgtgtaagtgcctttttttttaaagatggtgtatttcaaagtatttcatattaatgtactatatctacttgaagttccaatagtacattatgacagaaaccaaaagatctaacaattctgcttagctttttggttaagactccatgctttcattaccagaaaagggtcttacgtagtcattatgattcatggaattctattccatgaagccttaagaaaaaaaactttttttaactttccctgaaactttatcatttgataagtaaatttacttttcaagaagagtataaccaaagagtaaagataatgtgacactaagttatcaatgttttatgaatacacataaggcataaatttcagctgtaaaaaagctacattcaatctgactctggttttaaaacaaaactgctgtcataattatacatgatactgcaacttttggaaggctaatttggtggaatgttgcctcatcatagaacaccatagatcattaaaaattctataaaaattttaccaagctaccatatagttaataaaagggtatacagtcacttttatttctgaaaatataaaacattgagcctttcagtgtatctgatgcttctcttttggtaaggaatacttttatttcatggatcccaggcaggcatataaaagttacggaatttataaaatcatttgggataattagaaaatgcaattattcataacagaaaaataaagactttctagaaagcttctgactttgtcaatcatggctctgttcttaacaaagcactccttcctgagaatagtcctaagtgacaaagttgtttcagtacttttttgtaaaatatttaaaacattttaaaaccctaaattgatattcttaagaaactcaagatatcattggatatttactgcttcctcactcagtatttaaatttggttgtacttcgggggaaaacaacagagttattattttgctgcttactaaatagcaacttctcttgagcattatttgccttgtttgtaaagttaaaactgcgtaaaacagtaattctggaataaaacatacattctgcctacctcaaagaaatattctaagaacaaaaggaatactatccatgaaaatactttcattaatgtaaaattttcattatttagaccagcctaggttggcaaacttcttaaagggccagatagcaaatactgttattcttcgtgggtttaggcaaattcaagactattatacaggtaactatgtaaccatgtaagacttaagtacacttaaaaaatgtgaaaaaccattcctagcttccactacaacaacaacaaaaaacaggcaaccaatccaaccaacccagcctgtaagtctccatctcttatctccaaaataggaatacaaattgagtatcctttatctgaagtgcttgggaccagaagtatttaagactttggatttcttcagattttggagtatttgcattataccagttcaacattcctaacccaaaaatctgaaatctta

SEQ ID NO: 305418 - DNA, 2302 bp, Homo sapiens
agcggagaaacgcccggcctgccgcggcggcgcgaggggcgggctttcaggctcccggcggctgcttgcgccccagcgcgcgcccaggcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaaggctttaaaaaatattgcataccagtcatttcaacatcctacctagtgttacatgatttttgtgtaagtgcctttttttttaaagatggtgtatttcaaagtatttcatattaatgtactatatctacttgaagttccaatagtacattatgacagaaaccaaaagatctaacaattctgcttagctttttggttaagactccatgctttcattaccagaaaagggtcttacgtagtcattatgattcatggaattctattccatgaagccttaagaaaaaaaactttttttaactttccctgaaactttatcatttgataagtaaatttacttttcaagaagagtataaccaaagagtaaagataatgtgacactaagttatcaatgttttatgaatacacataaggcataaatttcagctgtaaaaaagctacattcaatctgactctggttttaaaacaaaactgctgtcataattatacatgatactgcaacttttggaaggctaatttggtggaatgttgcctcatcatagaacaccatagatcattaaaaattctataaaaattttaccaagctaccatatagttaataaaagggtatacagtcacttttatttctgaaaatataaaacattgagcctttcagtgtatctgatgcttctcttttggtaaggaatacttttatttcatggatcccaggcaggcatataaaagttacggaatttataaaatcatttgggataattagaaaatgcaattattcataacagaaaaataaagactttctagaaagcttcaaaaaaaaaacaaaaaaaaaaaaaaacaaacaaaaaaaaaaaaacaaaaaaaagggggggcccccaaaaaattatccccggagggggcaccaaagtacaacggaaaacccagaatttcgtggccaaaaggagggccccataaatgagaggcgacgaatatataaagaacacgagggcccgaggcgcgcccgctgcaaatagcaaacgcgcgccgacacagcggcgaacacagcccggcacagggcgaaacactattgtgcaagagagagaccaccactctcactcacgggggggggagggcaccacaatatgacgggcacaccaagtcctcaagg

SEQ ID NO: 305419 - DNA, 3852 bp, Homo sapiens
agcggagaaacgcccggcctgccgcggcggcgcgaggggcgggctttcaggctcccggcggctgcttgcgccccagcgcgcgcccaggcgccttggaatccccgtccttgggcccccgcaaggtccccggccgtgcgcgaggcagcatgatgaggcgcaccctggaaaaccggtaacagcccgagcccagctgcccagggccgcccacactggagggctggggtgagggaagtggaagcctctgtccatggggcctctgcgccgaattccgaccctgagtgggaggctgcacggtccccgctgtgacctggggcctaattccttgggctgcagccaccgccggcggcgaagaggagcccggggcccggccggctgccacccacccacgccaccgggtctcgggtccccacactgccgcgggcagtgcggaagcctaggaggcagccgggcgcccaggccgcgctgcgcggagcagccggagcagccacctccccagttaaggccaggcccacccggcctgggccttttcctgtgcctacacagtccggatagtgaggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggtgagcaagaaaccgtactctaaaggaatttgagctgctgcctttggaattgttgagttctaaaaatgtttcccctcagtcatatcacctcggtaacttatcctcccctggacctatttcttctcttctataaaatgacagaagattgcattaagtgcagctctattatttcttaattatcttttatactgtaattacatattactctctaaagcataacacttgagagcagaagtggaaaagacaaaagaatgctaatgcagatgtgttatctgctataatatgaagagcagattctgaagtccaacttaggtttaaatctcactatcaaaacttagtggatctcattaaattataaagttaaataccaaattatactaaaaaagggcttttactgaacacagaaatcatttcattttttttctatatccagaaagcttgagtttcccagtatctagagcaggggctgacaaactttttctttaagatgtggagactaacattcttaggctttgtgggccatatggtttctaccccaacaactataaataacaactgttaagtaacacataaagcagtatgactgtgttctaataaaattctatttacaaaagcaggaggctggctgggccgcaacttgccaaaccctgatctagagagctatgcccttttcatatctagccttcagaatataaaattcaacaaacttattttcaagatacaacttttaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaaggctttaaaaaatattgcataccagtcatttcaacatcctacctagtgttacatgatttttgtgtaagtgcctttttttttaaagatggtgtatttcaaagtatttcatattaatgtactatatctacttgaagttccaatagtacattatgacagaaaccaaaagatctaacaattctgcttagctttttggttaagactccatgctttcattaccagaaaagggtcttacgtagtcattatgattcatggaattctattccatgaagccttaagaaaaaaaactttttttaactttccctgaaactttatcatttgataagtaaatttacttttcaagaagagtataaccaaagagtaaagataatgtgacactaagttatcaatgttttatgaatacacataaggcataaatttcagctgtaaaaaagctacattcaatctgactctggttttaaaacaaaactgctgtcataattatacatgatactgcaacttttggaaggctaatttggtggaatgttgcctcatcatagaacaccatagatcattaaaaattctataaaaattttaccaagctaccatatagttaataaaagggtatacagtcacttttatttctgaaaatataaaacattgagcctttcagtgtatctgatgcttctcttttggtaaggaatacttttatttcatggatcccaggcaggcatataaaagttacggaatttataaaatcatttgggataattagaaaatgcaattattcataacagaaaaataaagactttctagaaagcttctgactttgtcaatcatggctctgttcttaacaaagcactccttcctgagaatagtcctaagtgacaaagttgtttcagtacttttttgtaaaatatttaaaacattttaaaaccctaaattgatattcttaagaaactcaagatatcattggatatttactgcttcctcactcagtatttaaatttggttgtacttcgggggaaaacaacagagttattattttgctgcttactaaatagcaacttctcttgagcattatttgccttgtttgtaaagttaaaactgcgtaaaacagtaattctggaataaaacatacattctgcctacctcaaagaaatattctaagaacaaaaggaatactatccatgaaaatactttcattaatgtaaaattttcattatttagaccagcctaggttggcaaacttcttaaagggccagatagcaaatactgttattcttcgtgggtttaggcaaattcaagactattatacaggtaactatgtaaccatgtaagacttaagtacacttaaaaaatgtgaaaaaccattcctagcttccactacaacaacaacaaaaaacaggcaaccaatccaaccaacccagcctgtaagtctccatctcttatctccaaaataggaatacaaattgagtatcctttatctgaagtgcttgggaccagaagtatttaagactttggatttcttcagattttggagtatttgcattataccagttcaacattcctaacccaaaaatctgaaatctta

SEQ ID NO: 305420 - DNA, 3081 bp, Homo sapiens
ccaatttactcttatgtaattttcatagcagtactgcagagttaaattggtaagagttgagaatttgcagaacagaaagattcaaaggtatgagtcgcagcctccctactagcttgcatgctctttgagggtctcaacttctgcagttctcctggcaaaagcatttaaatgattgtttcatgactaattactgtttaatatctgtcatcatcttacatagttcaaatagaatttttagctttcatctttctagcttatttttgttgtcttttcttttacatttacaataattggaattttgtccatttggggggagttgtttttttaaaaaaaaatcttaactaaggaacttaatttgactgtcttgattttgtttagcatctactttataatgctattttatcattacaataggttttccgaaattctctgtatgcaccagattattcatctcgtttagatattgtaagagcaaattcaaagtcacctcttcagagatcactgtcagctaagtgtgtatctggaacaggacaggtgagcaagaaaccgtactctaaaggaatttgagctgctgcctttggaattgttgagttctaaaaatgtttcccctcagtcatatcacctcggtaacttatcctcccctggacctatttcttctcttctataaaatgacagaagattgcattaagtgcagctctattatttcttaattatcttttatactgtaattacatattactctctaaagcataacacttgagagcagaagtggaaaagacaaaagaatgctaatgcagatgtgttatctgctataatatgaagagcagattctgaagtccaacttaggtttaaatctcactatcaaaacttagtggatctcattaaattataaagttaaataccaaattatactaaaaaagggcttttactgaacacagaaatcatttcattttttttctatatccagaaagcttgagtttcccagtatctagagcaggggctgacaaactttttctttaagatgtggagactaacattcttaggctttgtgggccatatggtttctaccccaacaactataaataacaactgttaagtaacacataaagcagtatgactgtgttctaataaaattctatttacaaaagcaggaggctggctgggccgcaacttgccaaaccctgatctagagagctatgcccttttcatatctagccttcagaatataaaattcaacaaacttattttcaagatacaacttttaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaaggctttaaaaaatattgcataccagtcatttcaacatcctacctagtgttacatgatttttgtgtaagtgcctttttttttaaagatggtgtatttcaaagtatttcatattaatgtactatatctacttgaagttccaatagtacattatgacagaaaccaaaagatctaacaattctgcttagctttttggttaagactccatgctttcattaccagaaaagggtcttacgtagtcattatgattcatggaattctattccatgaagccttaagaaaaaaaactttttttaactttccctgaaactttatcatttgataagtaaatttacttttcaagaagagtataaccaaagagtaaagataatgtgacactaagttatcaatgttttatgaatacacataaggcataaatttcagctgtaaaaaagctacattcaatctgactctggttttaaaacaaaactgctgtcataattatacatgatactgcaacttttggaaggctaatttggtggaatgttgcctcatcatagaacaccatagatcattaaaaattctataaaaattttaccaagctaccatatagttaataaaagggtatacagtcacttttatttctgaaaatataaaacattgagcctttcagtgtatctgatgcttctcttttggtaaggaatacttttatttcatggatcccaggcaggcatataaaagttacggaatttataaaatcatttgggataattagaaaatgcaattattcataacagaaaaataaagactttctagaaagcttctgactttgtcaatcatggctctgttcttaacaaagcactccttcctgagaatagtcctaagtgacaaagttgtttcagtacttttttgtaaaatatttaaaacattttaaaaccctaaattgatattcttaagaaactcaagatatcattggatatttactgcttcctcactcagtatttaaatttggttgtacttcgggggaaaacaacagagttattattttgctgcttactaaatagcaacttctcttgagcattatttgccttgtttgtaaagttaaaactgcgtaaaacagtaattctggaataaaacatacattctgcctacctcaaagaaatattctaagaacaaaaggaatactatccatgaaaatactttcattaatgtaaaattttcattatttagaccagcctaggttggcaaacttcttaaagggccagatagcaaatactgttattcttcgtgggtttaggcaaattcaagactattatacaggtaactatgtaaccatgtaagacttaagtacacttaaaaaatgtgaaaaaccattcctagcttccactacaacaacaacaaaaaacaggcaaccaatccaaccaacccagcctgtaagtctccatctcttatctccaaaataggaatacaaattgagtatcctttatctgaagtgcttgggaccagaagtatttaagactttggatttcttcagattttggagtatttgcattataccagttcaacattcctaacccaaaaatctgaaatctta

SEQ ID NO: 305421 - DNA, 2639 bp, Homo sapiens
agcggagaaacgcccggcctgccgcggcggcgcgaggggcgggctttcaggctcccggcggctgcttgcgccccagcgcgcgcccaggcgccttggaatccccgtccttgggcccccgcaaggtccccggccgtgcgcgaggcagcatgatgaggcgcaccctggaaaaccggtaacagcccgagcccagctgcccagggccgcccacactggagggctggggtgagggaagtggaagcctctgtccatggggcctctgcgccgaattccgaccctgagtgggaggctgcacggtccccgctgtgacctggggcctaattccttgggctgcagccaccgccggcggcgaagaggagcccggggcccggccggctgccacccacccacgccaccgggtctcgggtccccacactgccgcgggcagtgcggaagcctaggaggcagccgggcgcccaggccgcgctgcgcggagcagccggagcagccacctccccagttaaggccaggcccacccggcctgggccttttcctgtgcctacacagtccggatagtgaggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcaggcagaaacggaattacagagagctgcaatggatgctagccgaacaagtcgtcatctggaggaaactattaacaactttgaaaggcagaaaatgaaggatataaagctttaaaaaatattgcataccagtcatttcaacatcctacctagtgttacatgatttttgtgtaagtgcctttttttttaaagatggtgtatttcaaagtatttcatattaatgtactatatctacttgaagttccaatagtacattatgacagaaaccaaaagatctaacaattctgcttagctttttggttaagactccatgctttcattaccagaaaagggtcttacgtagtcattatgattcatggaattctattccatgaagccttaagaaaaaaaactttttttaactttccctgaaactttatcatttgataagtaaatttacttttcaagaagagtataaccaaagagtaaagataatgtgacactaagttatcaatgttttatgaatacacataaggcataaatttcagctgtaaaaaagctacattcaatctgactctggttttaaaacaaaactgctgtcataattatacatgatactgcaacttttggaaggctaatttggtggaatgttgcctcatcatagaacaccatagatcattaaaaattctataaaaattttaccaagctaccatatagttaataaaagggtatacagtcacttttatttctgaaaatataaaacattgagcctttcagtgtatctgatgcttctcttttggtaaggaatacttttatttcatggatcccaggcaggcatataaaagttacggaatttataaaatcatttgggataattagaaaatgcaattattcataacagaaaaataaagactttctagaaagcttctgactttgtcaatcatggctctgttcttaacaaagcactccttcctgagaatagtcctaagtgacaaagttgtttcagtacttttttgtaaaatatttaaaacattttaaaaccctaaattgatattcttaagaaactcaagatatcattggatatttactgcttcctcactcagtatttaaatttggttgtacttcgggggaaaacaacagagttattattttgctgcttactaaatagcaacttctcttgagcattatttgccttgtttgtaaagttaaaactgcgtaaaacagtaattctggaataaaacatacattctgcctacctcaaagaaatattctaagaacaaaaggaatactatccatgaaaatactttcattaatgtaaaattttcattatttagaccagcctaggttggcaaacttcttaaagggccagatagcaaatactgttattcttcgtgggtttaggcaaattcaagactattatacaggtaactatgtaaccatgtaagacttaagtacacttaaaaaatgtgaaaaaccattcctagcttccactacaacaacaacaaaaaacaggcaaccaatccaaccaacccagcctgtaagtctccatctcttatctccaaaataggaatacaaattgagtatcctttatctgaagtgcttgggaccagaagtatttaagactttggatttcttcagattttggagtatttgcattataccagttcaacattcctaacccaaaaatctgaaatctta

SEQ ID NO: 305422 - DNA, 2289 bp, Homo sapiens
ccagaaaccacatgaggagtggctctttgagagcatttgaggttccagaacacctccattcctgaggggagtctcttgagcagcgatttggggctgcgccagttgcttggtccttcttcctttggaccaaagaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaaggctttaaaaaatattgcataccagtcatttcaacatcctacctagtgttacatgatttttgtgtaagtgcctttttttttaaagatggtgtatttcaaagtatttcatattaatgtactatatctacttgaagttccaatagtacattatgacagaaaccaaaagatctaacaattctgcttagctttttggttaagactccatgctttcattaccagaaaagggtcttacgtagtcattatgattcatggaattctattccatgaagccttaagaaaaaaaactttttttaactttccctgaaactttatcatttgataagtaaatttacttttcaagaagagtataaccaaagagtaaagataatgtgacactaagttatcaatgttttatgaatacacataaggcataaatttcagctgtaaaaaagctacattcaatctgactctggttttaaaacaaaactgctgtcataattatacatgatactgcaacttttggaaggctaatttggtggaatgttgcctcatcatagaacaccatagatcattaaaaattctataaaaattttaccaagctaccatatagttaataaaagggtatacagtcacttttatttctgaaaatataaaacattgagcctttcagtgtatctgatgcttctcttttggtaaggaatacttttatttcatggatcccaggcaggcatataaaagttacggaatttataaaatcatttgggataattagaaaatgcaattattcataacagaaaaataaagactttctagaaagcttctgactttgtcaatcatggctctgttcttaacaaagcactccttcctgagaatagtcctaagtgacaaagttgtttcagtacttttttgtaaaatatttaaaacattttaaaaccctaaattgatattcttaagaaactcaagatatcattggatatttactgcttcctcactcagtatttaaatttggttgtacttcgggggaaaacaacagagttattattttgctgcttactaaatagcaacttctcttgagcattatttgccttgtttgtaaagttaaaactgcgtaaaacagtaattctggaataaaacatacattctgcctacctcaaagaaatattctaagaacaaaaggaatactatccatgaaaatactttcattaatgtaaaattttcattatttagaccagcctaggttggcaaacttcttaaagggccagatagcaaatactgttattcttcgtgggtttaggcaaattcaagactattatacaggtaactatgtaaccatgtaagacttaagtacacttaaaaaatgtgaaaaaccattcctagcttccactacaacaacaacaaaaaacaggcaaccaatccaaccaacccagcctgtaagtctccatctcttatctccaaaataggaatacaaattgagtatcctttatctgaagtgcttgggaccagaagtatttaagactttggatttcttcagattttggagtatttgcattataccagttcaacattcctaacccaaaaatctgaaatctta

SEQ ID NO: 305423 - DNA, 3687 bp, Homo sapiens
agcggagaaacgcccggcctgccgcggcggcgcgaggggcgggctttcaggctcccggcggctgcttgcgccccagcgcgcgcccaggcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagagaacctaaaacgggaatttcaattttcaaaaaacagaatgagtataaaaaaaattgaactcatcattgctatccatacaaatttgaagagtaatcatatttggaggtacttttggaaaaatgtggagttcttgtcatgaaacttctgtaataaacaagtaactctcaattatatatgataactggggacttaatgtttcaaagataatttatattcacaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggtgagcaagaaaccgtactctaaaggaatttgagctgctgcctttggaattgttgagttctaaaaatgtttcccctcagtcatatcacctcggtaacttatcctcccctggacctatttcttctcttctataaaatgacagaagattgcattaagtgcagctctattatttcttaattatcttttatactgtaattacatattactctctaaagcataacacttgagagcagaagtggaaaagacaaaagaatgctaatgcagatgtgttatctgctataatatgaagagcagattctgaagtccaacttaggtttaaatctcactatcaaaacttagtggatctcattaaattataaagttaaataccaaattatactaaaaaagggcttttactgaacacagaaatcatttcattttttttctatatccagaaagcttgagtttcccagtatctagagcaggggctgacaaactttttctttaagatgtggagactaacattcttaggctttgtgggccatatggtttctaccccaacaactataaataacaactgttaagtaacacataaagcagtatgactgtgttctaataaaattctatttacaaaagcaggaggctggctgggccgcaacttgccaaaccctgatctagagagctatgcccttttcatatctagccttcagaatataaaattcaacaaacttattttcaagatacaacttttaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaaggctttaaaaaatattgcataccagtcatttcaacatcctacctagtgttacatgatttttgtgtaagtgcctttttttttaaagatggtgtatttcaaagtatttcatattaatgtactatatctacttgaagttccaatagtacattatgacagaaaccaaaagatctaacaattctgcttagctttttggttaagactccatgctttcattaccagaaaagggtcttacgtagtcattatgattcatggaattctattccatgaagccttaagaaaaaaaactttttttaactttccctgaaactttatcatttgataagtaaatttacttttcaagaagagtataaccaaagagtaaagataatgtgacactaagttatcaatgttttatgaatacacataaggcataaatttcagctgtaaaaaagctacattcaatctgactctggttttaaaacaaaactgctgtcataattatacatgatactgcaacttttggaaggctaatttggtggaatgttgcctcatcatagaacaccatagatcattaaaaattctataaaaattttaccaagctaccatatagttaataaaagggtatacagtcacttttatttctgaaaatataaaacattgagcctttcagtgtatctgatgcttctcttttggtaaggaatacttttatttcatggatcccaggcaggcatataaaagttacggaatttataaaatcatttgggataattagaaaatgcaattattcataacagaaaaataaagactttctagaaagcttctgactttgtcaatcatggctctgttcttaacaaagcactccttcctgagaatagtcctaagtgacaaagttgtttcagtacttttttgtaaaatatttaaaacattttaaaaccctaaattgatattcttaagaaactcaagatatcattggatatttactgcttcctcactcagtatttaaatttggttgtacttcgggggaaaacaacagagttattattttgctgcttactaaatagcaacttctcttgagcattatttgccttgtttgtaaagttaaaactgcgtaaaacagtaattctggaataaaacatacattctgcctacctcaaagaaatattctaagaacaaaaggaatactatccatgaaaatactttcattaatgtaaaattttcattatttagaccagcctaggttggcaaacttcttaaagggccagatagcaaatactgttattcttcgtgggtttaggcaaattcaagactattatacaggtaactatgtaaccatgtaagacttaagtacacttaaaaaatgtgaaaaaccattcctagcttccactacaacaacaacaaaaaacaggcaaccaatccaaccaacccagcctgtaagtctccatctcttatctccaaaataggaatacaaattgagtatcctttatctgaagtgcttgggaccagaagtatttaagactttggatttcttcagattttggagtatttgcattataccagttcaacattcctaacccaaaaatctgaaatctta

SEQ ID NO: 305424 - DNA, 1871 bp, Homo sapiens
taaaatttttttaagttagtatttttattttaaaaagtgtgttaacttttaacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaaggctttaaaaaatattgcataccagtcatttcaacatcctacctagtgttacatgatttttgtgtaagtgcctttttttttaaagatggtgtatttcaaagtatttcatattaatgtactatatctacttgaagttccaatagtacattatgacagaaaccaaaagatctaacaattctgcttagctttttggttaagactccatgctttcattaccagaaaagggtcttacgtagtcattatgattcatggaattctattccatgaagccttaagaaaaaaaactttttttaactttccctgaaactttatcatttgataagtaaatttacttttcaagaagagtataaccaaagagtaaagataatgtgacactaagttatcaatgttttatgaatacacataaggcataaatttcagctgtaaaaaagctacattcaatctgactctggttttaaaacaaaactgctgtcataattatacatgatactgcaacttttggaaggctaatttggtggaatgttgcctcatcatagaacaccatagatcattaaaaattctataaaaattttaccaagctaccatatagttaataaaagggtatacagtcacttttatttctgaaaatataaaacattgagcctttcagtgtatctgatgcttctcttttggtaaggaatacttttatttcatggatcccaggcaggcatataaaagttacggaatttataaaatcatttgggataattagaaaatgcaattattcataacagaaaaataaagactttctagaaagcttctgactttgtcaatcatggctctgttcttaacaaagcactccttcctgagaatagtcctaagtgacaaagttgtttcagtacttttttgtaaaatatttaaaacattttaaaaccctaaattgatattcttaagaaactcaagatatcattggatatttactgcttcctcactcagtatttaaatttggttgtacttcgggggaaaacaacagagttattattttgctgcttactaaatagcaacttctcttgagcattatttgccttgtttgtaaagttaaaactgcgtaaaacagtaattctggaataaaacatacattctgcctacctcaaagaaatattctaagaacaaaaggaatactatccatgaaaatactttcattaatgtaaaattttcattatttagaccagcctaggttggcaaacttcttaaagggccagatagcaaatactgttattcttcgtgggtttaggcaaattcaagactattatacaggtaactatgtaaccatgtaagacttaagtacacttaaaaaatgtgaaaaaccattcctagcttccactacaacaacaacaaaaaacaggcaaccaatccaaccaacccagcctgtaagtctccatctcttatctccaaaataggaatacaaattgagtatcctttatctgaagtgcttgggaccagaagtatttaagactttggatttcttcagattttggagtatttgcattataccagttcaacattcctaacccaaaaatctgaaatctta

SEQ ID NO: 305425 - DNA, 1169 bp, Homo sapiens
agcggagaaacgcccggcctgccgcggcggcgcgaggggcgggctttcaggctcccggcggctgcttgcgccccagcgcgcgcccaggcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaagg

SEQ ID NO: 305426 - DNA, 1504 bp, Homo sapiens
agcggagaaacgcccggcctgccgcggcggcgcgaggggcgggctttcaggctcccggcggctgcttgcgccccagcgcgcgcccaggcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaaggaaaaaaaaaacaaaaaaaaaaaaaaacaaacaaaaaaaaaaaaacaaaaaaaagggggggcccccaaaaaattatccccggagggggcaccaaagtacaacggaaaacccagaatttcgtggccaaaaggagggccccataaatgagaggcgacgaatatataaagaacacgagggcccgaggcgcgcccgctgcaaatagcaaacgcgcgccgacacagcggcgaacacagcccggcacagggcgaaacactattgtgcaagagagagaccaccactctcactcacgggggggggagggcaccacaatatgacgggcacaccaagtcctcaagg

SEQ ID NO: 305427 - DNA, 791 bp, Homo sapiens
cacgcgtccgataaaaatgagtgaagccacctcaagtggacaaggcacttaccaacagagattgctgatttgctccttaagcaagagattcactgccgctaagcatggctcagaccaactcgttcttcatgctgatctcctccctgatgttcctgtctctgagccaaggccaggagtcccagacagagctgcctaatccccgaatcagctgcccagaaggcaccaatgcctatcgctcctactgctactactttaatgaagaccctgagacctgggttgatgcagatctctattgccagaacatgaattcaggcaacctggtgtctgtgctcacccaggcggagggtgccttcgtggcctcactgattaaggagagtagcactgatgacagcaatgtctggattggcctccatgacccaaaaaagaaccgccgctggcactggagtagtgggtccctggtctcctacaagtcctgggacactggatccccgagcagtgctaatgctggctactgtgcaagcctgacttcatgctcaggattcaagaaatggaaggatgaatcttgtgagaagaagttctcctttgtttgcaagttcaaaaactagaggaagctgaaaaatggatgtctagaactggtcctgcaattactatgaagtcaaaaattaaactagactatgtctccaactcagttcagaccatctcctccctaatgagtttgcatcgctgatcttcagtaccttcacctgtctcagtctctagagccctgaaaaataaaaacaaacttattttta

SEQ ID NO: 305428 - DNA, 903 bp, Homo sapiens
  misc_feature (8)..(8): n is a, c, g, or t
  misc_feature (12)..(12): n is a, c, g, or t
  misc_feature (41)..(41): n is a, c, g, or t
  misc_feature (55)..(55): n is a, c, g, or t
  misc_feature (63)..(63): n is a, c, g, or t
  misc_feature (66)..(66): n is a, c, g, or t
cggcgaangggnaccgggcccctttggacccagcgtccggnctgacccgacagcnacctcaanggncaaggcacttaccaacagagattgctgatttgctccttaagcaagagattcactgccgctaagcatggctcagaccaactcgttcttcatgctgatctcctccctgatgttcctgtctctgagccaaggccaggagtcccagacagagctgcctaatccccgaatcagctgcccagaaggcaccaatgcctatcgctcctactgctactactttaatgaagaccctgagacctgggttgatgcagatctctattgccagaacatgaattcaggcaacctggtgtctgtgctcacccaggcggagggtgccttcgtggcctcactgattaaggagagtagcactgatgacagcaatgtctggattggcctccatgacccaaaaaagaaccgccgctggcactggagtagtgggtccctggtctcctacaagtcctgggacactggatccccgagcagtgctaatgctggctactgtgcaagcctgacttcatgctcaggtgagaggcagacaatctatccacctgttgccatttccttcccacttatctctggggatgaacatggggactgggatagaggaaaggattcaagaaatggaaggatgaatcttgtgagaagaagttctcctttgtttgcaagttcaaaaactagaggaagctgaaaaatggatgtctagaactggtcctgcaattactatgaagtcaaaaattaaactagactatgtctccaactcagttcagaccatctcctccctaatgagtttgcatcgctgatcttcagtaccttcacctgtctcagtctctagagccctgaaaaataaaaacaaacttattttta

SEQ ID NO: 305429 - DNA, 817 bp, Homo sapiens
  misc_feature (8)..(8): n is a, c, g, or t
  misc_feature (12)..(12): n is a, c, g, or t
  misc_feature (41)..(41): n is a, c, g, or t
  misc_feature (55)..(55): n is a, c, g, or t
  misc_feature (63)..(63): n is a, c, g, or t
  misc_feature (66)..(66): n is a, c, g, or t
cggcgaangggnaccgggcccctttggacccagcgtccggnctgacccgacagcnacctcaanggncaaggcacttaccaacagagattgctgatttgctccttaagcaagagattcactgccgctaagcatggctcagaccaactcgttcttcatgctgatctcctccctgatgttcctgtctctgagccaaggccaggagtcccagacagagctgcctaatccccgaatcagctgcccagaaggcaccaatgcctatcgctcctactgctactactttaatgaagaccctgagacctgggttgatgcagatctctattgccagaacatgaattcaggcaacctggtgtctgtgctcacccaggcggagggtgccttcgtggcctcactgattaaggagagtagcactgatgacagcaatgtctggattggcctccatgacccaaaaaagaaccgccgctggcactggagtagtgggtccctggtctcctacaagtcctgggacactggatccccgagcagtgctaatgctggctactgtgcaagcctgacttcatgctcaggattcaagaaatggaaggatgaatcttgtgagaagaagttctcctttgtttgcaagttcaaaaactagaggaagctgaaaaatggatgtctagaactggtcctgcaattactatgaagtcaaaaattaaactagactatgtctccaactcagttcagaccatctcctccctaatgagtttgcatcgctgatcttcagtaccttcacctgtctcagtctctagagccctgaaaaataaaaacaaacttattttta

SEQ ID NO: 305430 - DNA, 877 bp, Homo sapiens
cacgcgtccgataaaaatgagtgaagccacctcaagtggacaaggcacttaccaacagagattgctgatttgctccttaagcaagagattcactgccgctaagcatggctcagaccaactcgttcttcatgctgatctcctccctgatgttcctgtctctgagccaaggccaggagtcccagacagagctgcctaatccccgaatcagctgcccagaaggcaccaatgcctatcgctcctactgctactactttaatgaagaccctgagacctgggttgatgcagatctctattgccagaacatgaattcaggcaacctggtgtctgtgctcacccaggcggagggtgccttcgtggcctcactgattaaggagagtagcactgatgacagcaatgtctggattggcctccatgacccaaaaaagaaccgccgctggcactggagtagtgggtccctggtctcctacaagtcctgggacactggatccccgagcagtgctaatgctggctactgtgcaagcctgacttcatgctcaggtgagaggcagacaatctatccacctgttgccatttccttcccacttatctctggggatgaacatggggactgggatagaggaaaggattcaagaaatggaaggatgaatcttgtgagaagaagttctcctttgtttgcaagttcaaaaactagaggaagctgaaaaatggatgtctagaactggtcctgcaattactatgaagtcaaaaattaaactagactatgtctccaactcagttcagaccatctcctccctaatgagtttgcatcgctgatcttcagtaccttcacctgtctcagtctctagagccctgaaaaataaaaacaaacttattttta

SEQ ID NO: 305431 - DNA, 307 bp, Homo sapiens
cacgcgtccgataaaaatgagtgaagccacctcaagtggacaaggcacttaccaacagagattgctgatttgctccttaagcaagagattcactgccgctaagcatggctcagaccaactcgttcttcatgctgatctcctccctgatgttcctgtctctgagccaaggccaggagtcccagacagagctgcctaatccccgaatcagctgcccagaaggcaccaatgcctatcgctcctactgctactactttaaaaaggaagaaacccccttgggagaaaccccccccggggtttttttgtattt

SEQ ID NO: 305432 - DNA, 212 bp, Homo sapiens
gtaagctccttatctggaaaataaagaagtatttcctctagttttttgttctgagtcctaggttgaggaggggctacactccttctgatcctctatgtctgacacttctcattgtaccataggattcaagaaatggaaggatgaatcttgtgagaagaagttctcctttgtttgcaagttcaaaaactagaggaagctgaaaaatggatgtc

SEQ ID NO: 305433 - DNA, 337 bp, Homo sapiens
ccctgtcatttatccagtgaaacattacaatagcctcccaatggcacttcccctactccaatccattctcttcaccttcttctaaaacacaaatctgatgcctcactccctgctctaaaccatctgacaggtccccaagcaccctcagaatgactggcatctccagccccatcttccaccacgcctcctccatgctgctccagaccactctccactcttgccatgcggtgttattcccaagtttctcaattggtgtccacccagctctgcctgtgttcttcctgttgcctggtgttcctttcctatggacacctcccctgccttcccacttttccca

SEQ ID NO: 305434 - DNA, 560 bp, Homo sapiens
agtctataagatctcctcaagcctgacttctccctacagtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggtactaccaagaggactggacagtggggaagggggtgggagatgggtgttgatccctgctccctcaagggaatgctataagctggagagagatcctgacaacccccagtgactatctttgtgcccatccctcaaaaaaaaaaa

SEQ ID NO: 305435 - DNA, 4170 bp, Homo sapiens
  misc_feature (3862)..(3863): n is a, c, g, or t
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcattgcgccccctgtgcctacctctagcattgtaacgaccacatagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccgaaaaaaaaaaaaaaaaaaaaaaaaaaaannaaaaaaaaaaaaaaaaaaaaataataaaaaaaaaccttgtgggccgcctggccccagtcgattttagattggagcaagttaatgcatgcggccgaatttggggctcatttgcccaatcccccttatagggagcggaataacaattaactggccggcggtttacaacgtcgggactggagttggggtataacaaagaggccccaacggttcgcctttcaaacatttgccaccttgattggggaatgaaatttgaagccttaatttttgttaaattgcgggtaaactttgggtaacaaatttattttaa

SEQ ID NO: 305436 - DNA, 1134 bp, Homo sapiens
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggtgccttttgggactgaggacaggatgtgggatgcggtggagggacacagggctgggttgggcatgggatggcgatcatgtcagagcctgccaagacacttgtgttcctcaggctagaaacctaaaaggggatgtggttcagtatacaggctttatgatcaaatacgaactcaaattctgactctgctacttactagctaccaggcatctagtacaacttacgttccttcccctaccctcaaatccattctaatttcctcttttgttcacatactaaggctgccagttctaactcccaaagagcctttggattaatctccttcttgccgtcttttgttacgaccaactccgttatttattcccactcctggactactgcccagctccccagctgatctgcagtctcctccctccaccccacccctcactgtactcccccactctgcttcaaaacagtctctccaacagtcaaaatggattggttccttctcctggttaaagcccttcacagcagggggagtgtgtgcttgtgaactgc

SEQ ID NO: 305437 - DNA, 3837 bp, Homo sapiens
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcattgcgccccctgtgcctacctctagcattgtaacgaccacatagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccgaaaa

SEQ ID NO: 305438 - DNA, 3821 bp, Homo sapiens
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaatcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcattgcgccccctgtgcctacctctagcattgtaacgaccacatagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccgaaaa

SEQ ID NO: 305439 - DNA, 3788 bp, Homo sapiens
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcattgcgccccctgtgcctacctctagcattgtaacgaccacatagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccgaaaa

SEQ ID NO: 305440 - DNA, 3001 bp, Homo sapiens
agtctataagatctcctcaagcctgacttctccctacagtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcattgcgccccctgtgcctacctctagcattgtaacgaccacatagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccgaaaa

SEQ ID NO: 305441 - DNA, 3925 bp, Homo sapiens
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcattgcgccccctgtgcctacctctagcattgtaacgaccacactaagatatatcttgtagagatttggggcccccccacacggctgttttaacccttttggttcttttggccccctttctccccttttgcccacaaagagcccgcttgggtggcacatatagagaggagctctatagagaatctcgtgtctctcctcatattgtatactcttgtgtggttccacaccggtctctagctccacggagttggccaataagaatttaatgtctgctaccccga

SEQ ID NO: 305442 - DNA, 2523 bp, Homo sapiens
gtgttctgtagagaaaagtgtgcacagtcacctcgggccatgccttgaaggctcaaaatctcttagtcaatcccatatacatgcttccccacagagtctagttcctccagcaagacctgggctatactcacccctccccacatatcttggaggtccccttgggtcccctactatccaaatgctgtcttctcccctcagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcattgcgccccctgtgcctacctctagcattgtaacgaccacatagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccgaaaa

SEQ ID NO: 305443 - DNA, 3438 bp, Homo sapiens
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatcttcctcccttgcattgcgccccctgtgcctacctctagcattgtaacgaccacatagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccgaaaa

SEQ ID NO: 305444 - DNA, 1685 bp, Homo sapiens
ctcacctgcaaaacgggtacagcattcctgtatgatagctcacgccgttgttgtgaaaaccacatagacttggtcaattctcggtcctactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcattgcgccccctgtgcctacctctagcattgtaacgaccacatagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccgaaaa

SEQ ID NO: 305445 - DNA, 3033 bp, Homo sapiens
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctgattaaactttaaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttaa

SEQ ID NO: 305446 - DNA, 2844 bp, Homo sapiens
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaaaaaaaaaacacaaagctccctgtaatcgagctgtccgacaacccctggcgtccatgaacctggtgagcctgaattaaatacattgg

SEQ ID NO: 305447 - DNA, 2863 bp, Homo sapiens
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctagagacagggtttcgccatgttgcccaggctggtcttgaactcctgacctccactgacccacccacctcagcctcccacagtgctgggcttacacacgtgagccacacagtgctgggcttacacacgtgagccaccatgctgaggagactgttttaaatgctctcttctttggtttttcagcctgagagacactctcgtaagttacatgcaaactaaagaaagtgaaattcttcctgaaatggcatctcagttcccagaagagatactgctcgccagctgtgtctcagtgtggaaaatagctgctgtgctgaaatggaatcgagaaatgagatagaattatttcctcagcctggtctccaagc

SEQ ID NO: 305448 - DNA, 2394 bp, Homo sapiens
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactcaggtggtgtggggtgccgagcc

SEQ ID NO: 305449 - DNA, 2365 bp, Homo sapiens
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagatacaccatacagagtctgtatacaacccttccgtaaagcctgattgaagatagaaacttgatatgcgtatggagaggcgttcagtgaatgcgagttc

SEQ ID NO: 305450 - DNA, 2174 bp, Homo sapiens
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagcccagcaaagaaccacacgccagcacaagaaccaacg

SEQ ID NO: 305451 - DNA, 1820 bp, Homo sapiens
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggtgagaatcagcccatctccaaactctc

SEQ ID NO: 305452 - DNA, 1835 bp, Homo sapiens
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacattctgtgatcacacaggactttctgacttgctggctgagcatccgacaagcagagctgctgctacctggggctgagtttcatcactatgtgggagacctacgaaacccagtgtggagaga

SEQ ID NO: 305453 - DNA, 1396 bp, Homo sapiens
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggtactaccaagaggactggacagtggggaagggggtgggagatgggtgttgatccctgctccctcaagggaatgctataagctggagagagatcctgacaacccccagtgactatctttgtgcccatccctcaaaaaaaaaaa

SEQ ID NO: 305454 - DNA, 922 bp, Homo sapiens
tcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactggatgagggcacatgccctcatccagtgggggggctacgtctgataggtgtagctataaaagggcaacacaataatggaaactgtggtaatataaatgttcagcctgactgtatagtgtcaatatcctggttctgatattgtactatatagttttgcaagatgtcaccactgggagaaactgggtagagggcacaggatccccttcccgcatttttttttattttttttaaaggagacggggtctggccctctgttcacccaggttggagtgct

SEQ ID NO: 305455 - DNA, 321 bp, Homo sapiens
gcatactgtgagctatggagatgatgaggactccctcagcagcgcctacatccagcgggtcaacactgagctcatgaaggctgccgctcggggtctcaccctgctcttcgcctcaggtgacctcctaccctaaacttagacaacgcttacacctctgcagcctgggagctttgactccacagtgatccctgagcctggtctctgactcataatctgaactcagaccttccagtagggaccactgacctgacctctacactctgacctcctacagtaacaaatttcccctctgacatccgaacccacatactaagccctaac

SEQ ID NO: 305456 - DNA, 611 bp, Homo sapiens
ccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccaggtgagccaagcaaagagccccagggtcctcatagcctccccacagtgtcctcaattccttaccaccctgggactcaccctcggacccacgatctctgctctgactccctccatagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggtactaccaagaggactggacagtggggaagggggtgggagatgggtgttgatccctgctccctcaagggaatgctataagctggagagagatcctgacaacccccagtgactatctttgtgcccatccct

SEQ ID NO: 305457 - DNA, 937 bp, Homo sapiens
aggcaatattctgtttgggttatcaaaagagcaactccatgctccgcattatttatagtccttattttaaagttttattagctctctttacagaacagatgtgaaggagttgagaggacaatcaactagattttatttttagaatataaagaacatttttaaaatgattaaacagcattaactgtacctcaggatctgcgcatgcatctgaatagcacacggctcaaatggtcctttccttttgttacatttagtagttgtgccatctttagtttttgctttgaacattgttttcctaaaagtcaactattactttcccatcaagttggttttatagttatgtctaaatttatggttcatgtcaaagtatttttgacttaatatccttttaaaaatatttaaactgatttattgctcaattggtgatagctgagaaaattttttcaatatgtagaattttcatggttattttgtatgaattatttttctgggtaagccatctgccacagaaattgacactatggtgagattaatgttaatgaaatgagcagtagagaagctactggattgctttaaaacattctttgattaaattactacatagttggtaagttcatagttttaagttacttaattgaagccctcagaagttgcaaagaatttatctgataaatctgcctttgcacaaatgtgatactgatgcatggacggctttgcggaatgacctttgatatttgtgcctagtggaaggtatggagctaaacaattaaagaactcttcattatggataggcacatattggatctctggtattttgggtagtggtattaacttaccaactatgtagtaatttaatcaaagaatgttttaaagcaatccagtagcttctctatagctcatttcattaacattaatctcaccatagtgtcaatttctg

SEQ ID NO: 305458 - DNA, 1847 bp, Homo sapiens
aggcaatattctgtttgggttatcaaaagagcaactccatgctccgcattatttatagtccttattttaaagttttattagctctctttacagaacagatgtgaaggagttgagaggacaatcaactagattttatttttagaatataaagaacatttttaaaatgattaaacagcattaactgtacctcaggatctgcgcatgcatctgaatagcacacggctcaaatggtcctttccttttgttacatttagtagttgtgccatctttagtttttgctttgaacattgttttcctaaaagtcaactattactttcccatcaagttggttttatagttatgtctaaatttatggttcatgtcaaagtatttttgacttaatatccttttaaaaatatttaaactgatttattgctcaattggtgatagctgagaaaattttttcaatatgtagaattttcatggttattttgtatgaattatttttctgggtaagccatctgccacagaaattgacactatggtgagattaatgttaatgaaatgagcagtagagaagctactggattgctttaaaacattctttgattaaattactacatagttggtaagttcatagttttaagttacttaattgaagccctcagaagttgcaaagaatttatctgataaatctgcctttgcacaaatgtgatactgatgcatggacggctttgcggaatgacctttgatatttgtgcctagtggaaggtatggagctaaacaattaaagaactcttcattatggataggcacatattggatctctggtattttgggtagtggtattaacttgacaattctaatttattttagttagtatatgtagcaagttagtatgtttgttagtagtttattgtacttcattccagttggtaatatagttttcatcacactaaactttttatactaaatttctgtagaagcttgttgggtttgccttcaccagaaggtactttaaatacctaccatagctgatttgttataaagaaacaaaatgggtgttcttctgtttccttttgattatgtttactgtaattatttcattttggatttatacatttacaattgaataaggattataggttgataagctgtttattgtgaaaagatgtgttttgttacaaatacttgttttaaaaattaataagcccccaggaagtacagcattgactggcacaactgcccatagtgagcttcccaactaactgccttcagtggattcgggcaagtgcaaagtctttggcctattgtgtgacaaagaggtatatattaaaggaaaagaaaaatgacatgaataagaaaattccgtcaacaaggttggagtagggagttgttgaggggtttagtttgttttaaaaggtatgtgagggagtggtggggtggatttgtgtttctgactttttttctttaagcaaattccatatgttaccaaaagcacatgctgtatattttcttccccttttgtgtgtatatagtattttgaaagataaatgaattgggtatttgtatgtgggatgtacaaaattgtggccgctctctttgtggaaggaaaaaacataaatgaagttaatgcacttcttttcctagcccaaaagtcactgtgattatatttttttaatgaagtttagaaaaaaagctgttgtcttctcaattgtaaaattagtttcaaaatgctgcttctcttatcattagtctagtaattgttgaacttttctgcaaactgcattttacaaaattgaaacttggaagctgtattaacttttatagttaaacattgtattaaataaactatactataataaaca

SEQ ID NO: 305459 - DNA, 2854 bp, Homo sapiens
  misc_feature (2006)..(2006): n is a, c, g, or t
aggcaatattctgtttgggttatcaaaagagcaactccatgctccgcattatttatagtccttattttaaagttttattagctctctttacagaacagatgtgaaggagttgagaggacaatcaactagattttatttttagaatataaagaacatttttaaaatgattaaacagcattaactgtacctcaggatctgcgcatgcatctgaatagcacacggctcaaatggtcctttccttttgttacatttagtagttgtgccatctttagtttttgctttgaacattgttttcctaaaagtcaactattactttcccatcaagttggttttatagttatgtctaaatttatggttcatgtcaaagtatttttgacttaatatccttttaaaaatatttaaactgatttattgctcaattggtgatagctgagaaaattttttcaatatgtagaattttcatggttattttgtatgaattatttttctgggtaagccatctgccacagaaattgacactatggtgagattaatgttaatgaaatgagcagtagagaagctactggattgctttaaaacattctttgattaaattactacatagttggtaagttcatagttttaagttacttaattgaagccctcagaagttgcaaagaatttatctgataaatctgcctttgcacaaatgtgatactgatgcatggacggctttgcggaatgacctttgatatttgtgcctagtggaaggtatggagctaaacaattaaagaactcttcattatggataggcacatattggatctctggtattttgggtagtggtattaacttgacaattctaatttattttagttagtatatgtagcaagttagtatgtttgttagtagtttattgtacttcattccagttggtaatatagttttcatcacactaaactttttatactaaatttctgtagaagcttgttgggtttgccttcaccagaaggtactttaaatacctaccatagctgatttgttataaagaaacaaaatgggtgttcttctgtttccttttgattatgtttactgtaattatttcattttggatttatacatttacaattgaataaggattataggttgataagctgtttattgtgaaaagatgtgttttgttacaaatacttgttttaaaaattaataagcccccaggaagtacagcattgactggcacaactgcccatagtgagcttcccaactaactgccttcagtggattcgggcaagtgcaaagtctttggcctattgtgtgacaaagaggtatatattaaaggaaaagaaaaatgacatgaataagaaaattccgtcaacaaggttggagtagggagttgttgaggggtttagtttgttttaaaaggtatgtgagggagtggtggggtggatttgtgtttctgactttttttctttaagcaaattccatatgttaccaaaagcacatgctgtatattttcttccccttttgtgtgtatatagtattttgaaagataaatgaattgggtatttgtatgtgggatgtacaaaattgtggccgctctctttgtggaaggaaaaaacataaatgaagttaatgcacttcttttcctagcccaaaagtcactgtgattatatttttttaatgaagtttagaaaaaaagctgttgtcttctcaattgtaaaattagtttcaaaatgctgcttctcttatcattagtctagtaattgttgaacttttctgcaaactgcattttacaaaattgaaacttggaagctgtattaacttttatagttaaacattgtattaaataaactatactataataaacaaaaaaaaaaaaaaaaaaaaaaaaaaaaaaaaaaaaaaaaaaaaaaaaaaaaaaaaaaaaaaaaaaaaggggggggaaaaaaaagggggaccaaacaattagaagaggcacaacaccaacaggttgttgtgtgcaaaaaaggcgtgccccctaagagagngggcgcccaataataaaaagcaccgagcaccacgagcgcacgacgtgaataacaacaccagccgtggggtgcgagggagaaaacacccgctgcctgagtgcggacgatactcggtgtgaaggaggacaacccctctagcggggggggggaagcaaccaaacagaggggggaaacacaactcacccgagagaagaataaaccaagcacggggagggaaaaaactaacacattcagagtgacacatgggggggtaaaaacaccaagcgggcgacataagacacccgggcgactgaaaaacaatggaggcgcccacccggcgcgggatatccagccaaagaacaatttttatccccaggagagatccattgcaaaaaagaccatgtccaggacgaagcacacaatgatcaatcaaccaccacaacactagtccaagaacgacaacagacaaacaggtaccagagacgaatggaaggagcaagaaacgaagaaaagaagagaaatcctacgaagcggagcgagcaaaagagacgcaagagagagaagacggggaaaaggacggaacagaaggaagaggcgcggaggagacggcaaggagagaagacgacagaagaaaaaggagacagcaaggcgacacgagaaggaaggagagatcagcgagaaggagctcagacaaccagagagagcgaggctggaagaggcgagagcgagacgagcccacgagaacgcaatacagccacaacaaataaggaaaagcaaacctaaaagaaagaaccaagaggcagagcagagcaccagcagaggagaaaaagcaggcgcagaacagacgagagaacagacacgacatagtg

SEQ ID NO: 305460 - DNA, 1309 bp, Homo sapiens
  misc_feature (1221)..(1221): n is a, c, g, or t
  misc_feature (1308)..(1308): n is a, c, g, or t
aggcaatattctgtttgggttatcaaaagagcaactccatgctccgcattatttatagtccttattttaaagttttattagctctctttacagaacagatgtgaaggagttgagaggacaatcaactagattttatttttagaatataaagaacatttttaaaatgattaaacagcattaactgtacctcaggatctgcgcatgcatctgaatagcacacggctcaaatggtcctttccttttgttacatttagtagttgtgccatctttagtttttgctttgaacattgttttcctaaaagtcaactattactttcccatcaagttggttttatagttatgtctaaatttatggttcatgtcaaagtatttttgacttaatatccttttaaaaatatttaaactgatttattgctcaattggtgatagctgagaaaattttttcaatatgtagaattttcatggttattttgtatgaattatttttctgggtaagccatctgccacagaaattgacactatggtgagattaatgttaatgaaatgagcagtagagaagctactggattgctttaaaacattctttgattaaattactacatagttggtaagttcatagttttaagttacttaattgaagccctcagaagttgcaaagaatttatctgataaatctgcctttgcacaaatgtgatactgatgcatggacggctttgcggaatgacctttgatatttgtgcctagtggaaggtatggagctaaacaattaaagaactcttcattatggataggcacatattggatctctggtattttgggtagtggtattaacttgacaattctaatttattttagttagtatatgtagcaagttagtatgtttgttagtagtttattgtacttcattccagttggtaatatagttttcatcacactaaactttttatactaaatttctgtgcccatttcaattgaaaagggcacagaaatttgaataacatatgatttgcatgtgtttgaaatattattttaatatttttaaaccattgagaattgttaaaaaaaaaacatttatagctcatgaactataaagaggtgggggccataatgatgctaacccctgttactaagggagcagagtccaaataggattatgctactagtaactagacgtagatgatgtagagaaatagagatgaccagatatgcgtattaaagtanactatgcattttgctacagttaattttcataccaaactgttccatacacagtacaaagcaaaggaatttctgtgcccatttcaaggng

SEQ ID NO: 305461 - DNA, 1063 bp, Homo sapiens
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatgaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaa

SEQ ID NO: 305462 - DNA, 946 bp, Homo sapiens
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatgaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattac

SEQ ID NO: 305463 - DNA, 485 bp, Homo sapiens
  misc_feature (1)..(1): n is a, c, g, or t
  misc_feature (7)..(7): n is a, c, g, or t
  misc_feature (16)..(17): n is a, c, g, or t
  misc_feature (32)..(32): n is a, c, g, or t
ncactgngcgggaggnnaatacctggcctgtntgaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaa

SEQ ID NO: 305464 - DNA, 696 bp, Homo sapiens
tgacacactaatgatacgcctcctcacagaaggaatttccgctagagagaaagatgctttctcctgcagaaataagttataaaatctagagagagctcagtcatttagttctacttgccgtacttcaagaggatcttcactgcagttgttttggtatggagtgataggaaaaagtcagggaggttgtacggtaagcaaaattggagaatgactgcccttgttctacaaatagaggtgtttgcttcagaatgtatacagaagatgaagctaggaaaataggagtggttggctgggtgaagaataccagcaaaggcaccgtgacaggccaagtgcaggggccagaagacaaagtcaattccatgaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattac

SEQ ID NO: 305465 - DNA, 960 bp, Homo sapiens
ggcggagcgacggcgtcgggggaggcggtggtggcggcagctggagcccaacgggctgcgccttcttcgccgtgggcccggctcggagcccccaccccaggcctcaccggcccagcgcgaggctgcctcaccggaaacacgaggccgaattccaagctattgtcctgcttcgccgggggtcgcgcactccaagcggcagcccactggagtcccagtcgccacgacaggcggcagccagactcagcctgcctgcacccaggtgaaataaacagccatgttgctcacacaaagcctgtttggtggtctcttcccacggacgcgcgagacaatgaggagatacaaggtctcgctgttctacctaggctgttctagaactcctaatgtcaagctatcctcctgcctcggcctcccatgctgttgggattacagctataaattcatacaattatcagagtttggttttggtcaagtcataattgtgagtgaagaaccatggaaggagaacatttcttgctcatcaactactttcataaaatcaacaatttgcttaaagaactaatgtttcttcagtctctaaggactcagctccttacatgagctttggtggaggtaatgaggcagcacctgcaggtctaaatcgagatgggaatgttcagccttcgtgggcttcacaagattgattcctgactaccttgctgtgaatggcacaactcacaccataatgcagcttcatatacagcttgggaagcacataggcatcaaagatattctttagaaatgtccctaacaactgcagcctttgctgtgttttgaatgatgaacctaatagccttatccgtaggctgcacatggctgtgatcctttgtggcaacaccattgtttcttcttttctttgtcatcttggaagcaaggaccctaaaaacaatatttttattgttttattatctgcctgacacatct

SEQ ID NO: 305466 - DNA, 619 bp, Homo sapiens
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtaggaggcccctctacggtgggagatcaaaaaggttatgggaggaaggggagaaagctgtgagaagcgcctcccacctaaagtatgccttttcccgttgtggctgggacttccgctccgccatgacacagcagc

SEQ ID NO: 305467 - DNA, 729 bp, Homo sapiens
ggcggagcgacggcgtcgggggaggcggtggtggcggcagctggagcccaacgggctgcgccttcttcgccgtgggcccggctcggagcccccaccccaggcctcaccggcccagcgcgaggctgcctcaccggaaacacgaggccgaattccaagctattgtcctgcttcgccgggggtcgcgcactccaagcggcagcccactggagtcccagtcgccacgacaggcggcagccagactcagcctgcctgcacccaggtgaaataaacagccatgttgctcacacaaagcctgtttggtggtctcttcccacggacgcgcgagacaatgaggagatacaaggtctcgctgttctacctaggctgttctagaactcctaatgtcaagctatcctcctgcctcggcctcccatgctgttgggattacagctataaattcatacaattatcagagtttggttttggtcaagtcataattgtgagtgaagaaccatggaaggagaacatttcttgctcatcaactactttcataaaatcaacaatttgcttaaatccagactctgaattcagaccatgtttcaatgcttggctatccctgatcagggaaaatgcagttggtctctgagtcacactgtgaaatagtattcagagctgaggcttcatctgcagtgcttgattcaacagatccctgggctggtgtgagtaagtggaaagccattttagagaagc

SEQ ID NO: 305468 - DNA, 1361 bp, Homo sapiens
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatactggattttaccctgttggccagtctggtcttgaacccctggcctcaagtgatccgcctgccatggcctcccaaagtgctgggattacagtggtgtctccaaatcctgagtcttctgtgaggtccatgggggaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaatgtgatgatcaatataaccataaaatattatcaacaaagagttttaaaattctg

SEQ ID NO: 305469 - DNA, 1428 bp, Homo sapiens
ggcggagcgacggcgtcgggggaggcggtggtggcggcagctggagcccaacgggctgcgccttcttcgccgtgggcccggctcggagcccccaccccaggcctcaccggcccagcgcgaggctgcctcaccggaaacacgaggccgaattccaagctattgtcctgcttcgccgggggtcgcgcactccaagcggcagcccactggagtcccagtcgccacgacaggcggcagccagactcagcctgcctgcacccaggtgaaataaacagccatgttgctcacacaaagcctgtttggtggtctcttcccacggacgcgcgagacaatgaggagatacaaggtctcgctgttctacctaggctgttctagaactcctaatgtcaagctatcctcctgcctcggcctcccatgctgttgggattacagctataaattcatacaattatcagagtttggttttggtcaagtcataattgtgagtgaagaaccatggaaggagaacatttcttgctcatcaactactttcataaaatcaacaatttgcttaagtgtttgcttcagaatgtatacagaagatgaagctaggaaaataggagtggttggctgggtgaagaataccagcaaaggcaccgtgacaggccaagtgcaggggccagaagacaaagtcaattccatactggattttaccctgttggccagtctggtcttgaacccctggcctcaagtgatccgcctgccatggcctcccaaagtgctgggattacagtggtgtctccaaatcctgagtcttctgtgaggtccatgggggaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaatgtgatgatcaatataaccataaaatattatcaacaaagagttttaaaattctg

SEQ ID NO: 305470 - DNA, 1315 bp, Homo sapiens
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatttagcttttcccttctattgaagccttgatagcccagatacccaacaactttggagtcatgcctctaccctcaagctggagtgtcagaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaatgtgatgatcaatataaccataaaatattatcaacaaagagttttaaaattctg

SEQ ID NO: 305471 - DNA, 1324 bp, Homo sapiens
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatgttggagtgcagtggcacaatctcggctcactacaacctctgccttccaggctcagatctccccgactcagcctcccaagtagctgggactacaggaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaatgtgatgatcaatataaccataaaatattatcaacaaagagttttaaaattctg

SEQ ID NO: 305472 - DNA, 1743 bp, Homo sapiens
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatactggattttaccctgttggccagtctggtcttgaacccctggcctcaagtgatccgcctgccatggcctcccaaagtgctgggattacagtggtgtctccaaatcctgagtcttctgtgaggtccatgggggccatgaaaatgtggaatacaacagggaccatcatttagagatggcctggctgtgattatagcagccctgctctgtctttactaacaagccagcagcatcagaccattagtggcatgaatgtctgtgcaaccagagtggctagcttttccttgctttttcatctgagtatttcaagactaggttagagcaggcagtacagtttctgcctggctctactggacatacctttggatccctgtgacaacacacacataaaatgtctggctactttgaagctgccatgctgaagaagtcatgtagggatagagggagacgactgaggagccagagctgttgcagaacccagctgactgagttttcccagcatcatctgccagacttgaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaatgtgatgatcaatataaccataaaatattatcaacaaagagttttaaaattctg

SEQ ID NO: 305473 - DNA, 1368 bp, Homo sapiens
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatataaatatctacatacaggggtgatatgaagattaattaaataagttgaaatgtagtggttaagagtggaattcatcagctccggaagctgggtgaagaaaagaaacaagatagggcaacagctagaggagaattccaggaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaatgtgatgatcaatataaccataaaatattatcaacaaagagttttaaaattctg

SEQ ID NO: 305474 - DNA, 1203 bp, Homo sapiens
ggcggagcgacggcgtcgggggaggcggtggtggcggcagctggagcccaacgggctgcgccttcttcgccgtgggcccggctcggagcccccaccccaggcctcaccggcccagcgcgaggctgcctcaccggaaacacgaggccgaattccaagctattgtcctgcttcgccgggggtcgcgcactccaagcggcagcccactggagtcccagtcgccacgacaggcggcagccagactcagcctgcctgcacccaggtgaaataaacagccatgttgctcacacaaagcctgtttggtggtctcttcccacggacgcgcgagacaatgaggagctataaattcatacaattatcagagtttggttttggtcaagtcataattgtgagtgaagaaccatggaaggagaacatttcttgctcatcaactactttcataaaatcaacaatttgcttaagtgtttgcttcagaatgtatacagaagatgaagctaggaaaataggagtggttggctgggtgaagaataccagcaaaggcaccgtgacaggccaagtgcaggggccagaagacaaagtcaattccatgaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaatgtgatgatcaatataaccataaaatattatcaacaaagagttttaaaattctg

SEQ ID NO: 305475 - DNA, 1100 bp, Homo sapiens
  misc_feature (1071)..(1072): n is a, c, g, or t
  misc_feature (1075)..(1075): n is a, c, g, or t
  misc_feature (1077)..(1077): n is a, c, g, or t
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatgaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaaaaaaannaananatggcctacatgtactaaaagaa

SEQ ID NO: 305476 - DNA, 1102 bp, Homo sapiens
  misc_feature (1064)..(1064): n is a, c, g, or t
  misc_feature (1092)..(1092): n is a, c, g, or t
  misc_feature (1100)..(1100): n is a, c, g, or t
  misc_feature (1102)..(1102): n is a, c, g, or t
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatgaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaantggcctcgttggctcagcggtggagctngccggccnan

SEQ ID NO: 305477 - DNA, 1117 bp, Homo sapiens
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatgaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaacattcaccaactacaaaccaaaaaacacacgccctcgctggccctatccggcgc

SEQ ID NO: 305478 - DNA, 851 bp, Homo sapiens
atgagccaccgcacccggccgaggtgcagaaatgttaatttgcagatggacacataggaaatggcgaggcgaagaaatgaacccaggcaatctgagcctataaagctcttccttttaaactctacggggtactctctgagccattctcagctacaaaagagggaattcatcagctccggaagctgggtgaagaaaagaaacaagatagggcaacagctagaggagaattccaggaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaatgtgatgatcaatataaccataaaatattatcaacaaagagttttaaaattctg

SEQ ID NO: 305479 - DNA, 679 bp, Homo sapiens
aggtgattgagcctgaagttgtctcactcgttttacatacacaataacaatttttgagcaagaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaatgtgatgatcaatataaccataaaatattatcaacaaagagttttaaaattctg

SEQ ID NO: 305480 - DNA, 670 bp, Homo sapiens
ttcgtggtaatatcggcgcgacgcagcccgcagaggcgacaaggaaaacctagaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaatgtgatgatcaatataaccataaaatattatcaacaaagagttttaaaattctg

SEQ ID NO: 305481 - DNA, 678 bp, Homo sapiens
aacacaaccgctcgcgccgaccccaacaccgccccacaccccacaaaaccctaggagcacgaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaatgtgatgatcaatataaccataaaatattatcaacaaagagttttaaaattctg

SEQ ID NO: 305482 - DNA, 1149 bp, Homo sapiens
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatttagcttttcccttctattgaagccttgatagcccagatacccaacaactttggagtcatgcctctaccctcaagctggagtgtcagaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaa

SEQ ID NO: 305483 - DNA, 1266 bp, Homo sapiens
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatactggattttaccctgttggccagtctggtcttgaacccctggcctcaagtgatccgcctgccatggcctcccaaagtgctgggattacagtggtgtctccaaatcctgagtcttctgtgaggtccatgggggaattcatcagctccggaagctgggtgaagaaaagaaacaagatagggcaacagctagaggagaattccaggaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaa

SEQ ID NO: 305484 - DNA, 1577 bp, Homo sapiens
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatactggattttaccctgttggccagtctggtcttgaacccctggcctcaagtgatccgcctgccatggcctcccaaagtgctgggattacagtggtgtctccaaatcctgagtcttctgtgaggtccatgggggccatgaaaatgtggaatacaacagggaccatcatttagagatggcctggctgtgattatagcagccctgctctgtctttactaacaagccagcagcatcagaccattagtggcatgaatgtctgtgcaaccagagtggctagcttttccttgctttttcatctgagtatttcaagactaggttagagcaggcagtacagtttctgcctggctctactggacatacctttggatccctgtgacaacacacacataaaatgtctggctactttgaagctgccatgctgaagaagtcatgtagggatagagggagacgactgaggagccagagctgttgcagaacccagctgactgagttttcccagcatcatctgccagacttgaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaa

SEQ ID NO: 305485 - DNA, 1186 bp, Homo sapiens
  misc_feature (1157)..(1158): n is a, c, g, or t
  misc_feature (1161)..(1161): n is a, c, g, or t
  misc_feature (1163)..(1163): n is a, c, g, or t
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatttagcttttcccttctattgaagccttgatagcccagatacccaacaactttggagtcatgcctctaccctcaagctggagtgtcagaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaaaaaaannaananatggcctacatgtactaaaagaa

SEQ ID NO: 305486 - DNA, 1188 bp, Homo sapiens
  misc_feature (1150)..(1150): n is a, c, g, or t
  misc_feature (1178)..(1178): n is a, c, g, or t
  misc_feature (1186)..(1186): n is a, c, g, or t
  misc_feature (1188)..(1188): n is a, c, g, or t
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatttagcttttcccttctattgaagccttgatagcccagatacccaacaactttggagtcatgcctctaccctcaagctggagtgtcagaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaantggcctcgttggctcagcggtggagctngccggccnan

SEQ ID NO: 305487 - DNA, 1078 bp, Homo sapiens
ttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatactggattttaccctgttggccagtctggtcttgaacccctggcctcaagtgatccgcctgccatggcctcccaaagtgctgggattacagtggtgtctccaaatcctgagtcttctgtgaggtccatgggggaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattac

SEQ ID NO: 305488 - DNA, 473 bp, Homo sapiens
ggcggagcgacggcgtcgggggaggcggtggtggcggcagctggagcccaacgggctgcgccttcttcgccgtgggcccggctcggagcccccaccccaggcctcaccggcccagcgcgaggctgcctcaccggaaacacgaggccgaattccaagctattgtcctgcttcgccgggggtcgcgcactccaagcggcagcccactggagtcccagtcgccacgacaggcggcagccagactcagcctgcctgcacccaggtgaaataaacagccatgttgctcacacaaagcctgtttggtggtctcttcccacggacgcgcgagacaatgaggagagaagcagttccagatgacaatgagctccctagaaacaaacatctgaactggaaaagttgaagaatttacgggagcaagcaaaataaggtctcttcctcttattctaaataaagtttcatggagaacactattgaaa

SEQ ID NO: 305489 - DNA, 875 bp, Homo sapiens
cccctgcccggagtgaactctgccctgaccccacccccagccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggccagcctcgca

SEQ ID NO: 305490 - DNA, 418 bp, Homo sapiens
actggggttggtggcatggcccaggaccccacgctgactagtgagcccctccgcaggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtca

SEQ ID NO: 305491 - DNA, 757 bp, Homo sapiens
ctctgtgagggcaggtgaggcgctcacagcctcgcgaaggtggagaagggcaggggcaggagagggctgcggaggaggggccacggtgcagcaggccgtggggactgccatgcactctgcctggtgtcacatgcccacagcagcctcggtgacgagagcacggagcccaagaggtggggtgtcttggctctgcccaggatctgagctcattggtcaaagcccgggtcaccatgcacaatcctctggcctggctgggccactgccctctgtccatctcttgcagtggtggggtcggacgccgtggactctgcacagtcctctgccctctgtccgtctcttgcagtggtggggtcagatgctgtggactctgggacctgcagctctgcctttgctggctgggaggtgcacacgcgaggtataggctccagactcctcaccaagatgggctatgagtttggcaaggcaagggtgagtacaagctgccctggagaagtgggcaggctgctgcagcatagcccaggtccagcagccatcaggttcccggggtcccgcagccatcgggttcccagggtcccgcagacacagcactgccatccccgtgctcctcggattcccggggtcccgcggccacagcactgccatccccgtgctcctcagattcccagggtcctacggccacagcactgccatctccgtgctcctcagattcccggggtcccgtggccacagcactgccatccccgtgctcctcagattc

SEQ ID NO: 305492 - DNA, 4380 bp, Homo sapiens
agcacttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttggtaagtgccctcctggggggcagctggggtctgggaggccttgggatgtggctgcagctgggtcagtcagccaggctgaagcccactccctgggtctgagcagactggccccaaactccagagaccacccctcaccccccagcttctgtctctgctgctggactgtgctgtttgtaaggcatcccccaccccgagaagttctgctaagatccccaagaaggggacagatcctctctggcagagacactggcagacaagaagagccagagagaagtggggtgggggcatcagcacccccagcagctgctgctgcctgctgacccagcctccagctcctccgggtgcagggtccctcctgctgaccagcctccagctcttcccagttctgggctccgcagcgagcggcttgggggcactacctgacacaggagaccatgtctgggcagagggtggctgcaggtggagtctgtggcctgtggcgcacacccaggggctcccccgatgctggttactatctgggctatggtggccacagctgtcttgcccctcctcacggccgtgctgggtgttaccgtggtcacccgcagggacacggaggggccaggcagagcagccctagttcacctcaccgggagcccccgccagaaggtgggcacctctgggagggagggactgccaggccttggggcttcctgtgctgagtcagagctggaacgggagacgcaggagccccgcagccgcgggaggtgcagatttggggctgccaggtggcgccaggtccccttggccagcccccagcgcccctttcttctgtccccagggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggccagcctcgca

SEQ ID NO: 305493 - DNA, 4450 bp, Homo sapiens
agcacttccggaagcggcggcgctcgggaggaagtgccgatcggctgctggggcgaaaagggggcgccgggccgctctagccggtgaggccggcgggctctctgtggctgcggctgggaaaccgcgcggaggaggtgcccggccggggaccagccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttggtaagtgccctcctggggggcagctggggtctgggaggccttgggatgtggctgcagctgggtcagtcagccaggctgaagcccactccctgggtctgagcagactggccccaaactccagagaccacccctcaccccccagcttctgtctctgctgctggactgtgctgtttgtaaggcatcccccaccccgagaagttctgctaagatccccaagaaggggacagatcctctctggcagagacactggcagacaagaagagccagagagaagtggggtgggggcatcagcacccccagcagctgctgctgcctgctgacccagcctccagctcctccgggtgcagggtccctcctgctgaccagcctccagctcttcccagttctgggctccgcagcgagcggcttgggggcactacctgacacaggagaccatgtctgggcagagggtggctgcaggtggagtctgtggcctgtggcgcacacccaggggctcccccgatgctggttactatctgggctatggtggccacagctgtcttgcccctcctcacggccgtgctgggtgttaccgtggtcacccgcagggacacggaggggccaggcagagcagccctagttcacctcaccgggagcccccgccagaaggtgggcacctctgggagggagggactgccaggccttggggcttcctgtgctgagtcagagctggaacgggagacgcaggagccccgcagccgcgggaggtgcagatttggggctgccaggtggcgccaggtccccttggccagcccccagcgcccctttcttctgtccccagggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggccagcctcgca

SEQ ID NO: 305494 - DNA, 4431 bp, Homo sapiens
agcacttccggaagcggcggcgctcgggaggaagtgccgatcggctgctggggcgaaaagggggcgccgggccgctctagccggtgaggccggcgggctctctgtggctgcggctgggaaaccgcgcggaggagccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttggtaagtgccctcctggggggcagctggggtctgggaggccttgggatgtggctgcagctgggtcagtcagccaggctgaagcccactccctgggtctgagcagactggccccaaactccagagaccacccctcaccccccagcttctgtctctgctgctggactgtgctgtttgtaaggcatcccccaccccgagaagttctgctaagatccccaagaaggggacagatcctctctggcagagacactggcagacaagaagagccagagagaagtggggtgggggcatcagcacccccagcagctgctgctgcctgctgacccagcctccagctcctccgggtgcagggtccctcctgctgaccagcctccagctcttcccagttctgggctccgcagcgagcggcttgggggcactacctgacacaggagaccatgtctgggcagagggtggctgcaggtggagtctgtggcctgtggcgcacacccaggggctcccccgatgctggttactatctgggctatggtggccacagctgtcttgcccctcctcacggccgtgctgggtgttaccgtggtcacccgcagggacacggaggggccaggcagagcagccctagttcacctcaccgggagcccccgccagaaggtgggcacctctgggagggagggactgccaggccttggggcttcctgtgctgagtcagagctggaacgggagacgcaggagccccgcagccgcgggaggtgcagatttggggctgccaggtggcgccaggtccccttggccagcccccagcgcccctttcttctgtccccagggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggccagcctcgca

SEQ ID NO: 305495 - DNA, 3560 bp, Homo sapiens
agcacttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggccagcctcgca

SEQ ID NO: 305496 - DNA, 3130 bp, Homo sapiens
aagccacacccaccacaaccgccccaacatagcagtgaggccggggtgaatcggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggccagcctcgca

SEQ ID NO: 305497 - DNA, 3188 bp, Homo sapiens
aggtattttattctctttgaagcaattgtgaatgggagttcactcatgatttggctctgtttgtctgttattggtgtataagaatgcttgtgatttttgtacattgattttgtatcctgagactttgctgaagttgcttatcagcttaaggagattttgggctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggccagcctcgca

SEQ ID NO: 305498 - DNA, 3630 bp, Homo sapiens
agcacttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcggtgagtgccaggctgtcccggggaccagggtggggtccgcagggcaccgaccagccttcctcgcccccagtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggccagcctcgca

SEQ ID NO: 305499 - DNA, 3525 bp, Homo sapiens
agcacttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggccagcctcgca

SEQ ID NO: 305500 - DNA, 4345 bp, Homo sapiens
agcacttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttggtaagtgccctcctggggggcagctggggtctgggaggccttgggatgtggctgcagctgggtcagtcagccaggctgaagcccactccctgggtctgagcagactggccccaaactccagagaccacccctcaccccccagcttctgtctctgctgctggactgtgctgtttgtaaggcatcccccaccccgagaagttctgctaagatccccaagaaggggacagatcctctctggcagagacactggcagacaagaagagccagagagaagtggggtgggggcatcagcacccccagcagctgctgctgcctgctgacccagcctccagctcctccgggtgcagggtccctcctgctgaccagcctccagctcttcccagttctgggctccgcagcgagcggcttgggggcactacctgacacaggagaccatgtctgggcagagggtggctgcaggtggagtctgtggcctgtggcgcacacccaggggctcccccgatgctggttactatctgggctatggtggccacagctgtcttgcccctcctcacggccgtgctgggtgttaccgtggtcacccgcagggacacggaggggccaggcagagcagccctagttcacctcaccgggagcccccgccagaaggtgggcacctctgggagggagggactgccaggccttggggcttcctgtgctgagtcagagctggaacgggagacgcaggagccccgcagccgcgggaggtgcagatttggggctgccaggtggcgccaggtccccttggccagcccccagcgcccctttcttctgtccccagggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggccagcctcgca

SEQ ID NO: 305501 - DNA, 3244 bp, Homo sapiens
agcacttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggccagcctcgca

SEQ ID NO: 305502 - DNA, 3620 bp, Homo sapiens
agcacttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcggacgccgtggactctgcacagtcctctgccctctgtccgtctcttgcagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggccagcctcgca

SEQ ID NO: 305503 - DNA, 3445 bp, Homo sapiens
agcacttccggaagcggcggcgctcgggaggaagtgccgatcggctgctggggcgaaaagggggcgccgggccgctctagccggtgaggccggcgggctctctgtggctgcggctgggaaaccgcgcggaggaggtgcccggccggggaccagccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggccagcctcgca

SEQ ID NO: 305504 - DNA, 1870 bp, Homo sapiens
agcacttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtca

SEQ ID NO: 305505 - DNA, 3017 bp, Homo sapiens
tctcagctcactgcagcctccgccgcccaggcgattctcctgcctcagcctcctgagtagacgtttcccggccaaggtgtttctttttgaatgttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcggacgccgtggactctgcacagtcctctgccctctgtccgtctcttgcagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggccagcctcgca

SEQ ID NO: 305506 - DNA, 2921 bp, Homo sapiens
ctctgtgagggcaggtgaggcgctcacagcctcgcgaaggtggagaagggcaggggcaggagagggctgcggaggaggggccacggtgcagcaggccgtggggactgccatgcactctgcctggtgtcacatgcccacagcagcctcggtgacgagagcacggagcccaagaggtggggtgtcttggctctgcccaggatctgagctcattggtcaaagcccgggtcaccatgcacaatcctctggcctggctgggccactgccctctgtccatctcttgcagtggtggggtcggacgccgtggactctgcacagtcctctgccctctgtccgtctcttgcagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggccagcctcgca

SEQ ID NO: 305507 - DNA, 4150 bp, Homo sapiens
agcacttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttggtaagtgccctcctggggggcagctggggtctgggaggccttgggatgtggctgcagctgggtcagtcagccaggctgaagcccactccctgggtctgagcagactggccccaaactccagagaccacccctcaccccccagcttctgtctctgctgctggactgtgctgtttgtaaggcatcccccaccccgagaagttctgctaagatccccaagaaggggacagatcctctctggcagagacactggcagacaagaagagccagagagaagtggggtgggggcatcagcacccccagcagctgctgctgcctgctgacccagcctccagctcctccgggtgcagggtccctcctgctgaccagcctccagctcttcccagttctgggctccgcagcgagcggcttgggggcactacctgacacaggagaccatgtctgggcagagggtggctgcaggtggagtctgtggcctgtggcgcacacccaggggctcccccgatgctggttactatctgggctatggtggccacagctgtcttgcccctcctcacggccgtgctgggtgttaccgtggtcacccgcagggacacggaggggccaggcagagcagccctagttcacctcaccgggagcccccgccagaaggtgggcacctctgggagggagggactgccaggccttggggcttcctgtgctgagtcagagctggaacgggagacgcaggagccccgcagccgcgggaggtgcagatttggggctgccaggtggcgccaggtccccttggccagcccccagcgcccctttcttctgtccccagggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcggtgagtgccaggctgtcccggggaccagggtggggtccgcagggcaccgaccagccttcctcgcccccagtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggccagcctcgca

SEQ ID NO: 305508 - DNA, 2870 bp, Homo sapiens
agcacttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcggtgagtgccaggctgtcccggggaccagggtggggtccgcagggcaccgaccagccttcctcgcccccagtccctactgaggcggacccacctctgctccctcagcaagtcggacaccagactgcacgagctgcaccggggcccgcgcagcagcaggggtgagcagagggcggggcgggggcggccgggcggggcttactgtgcagcgcgtgccaacccctgggccagacccg

SEQ ID NO: 305509 - DNA, 1996 bp, Homo sapiens
agcacttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcaaaaaaaaaaaaagggcggccgccctttttttttttttttttttttttttttttttctctaaggaatcaatatttcaatatgttgagtgtgtgtccaatgctatgaaattaaaatattaaataacaa

SEQ ID NO: 305510 - DNA, 1595 bp, Homo sapiens
agcacttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaaccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtca

SEQ ID NO: 305511 - DNA, 1041 bp, Homo sapiens
agcacttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagattctgtcgcgctagtcggggggtaccagctcgattcgtatatgttc

SEQ ID NO: 305512 - DNA, 247 bp, Homo sapiens
ccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtaacgtgggccagggt

SEQ ID NO: 305513 - DNA, 4338 bp, Homo sapiens
gccatggcggcggcagcggcgacgagaacggcgagcgaggggtcgagcgcggccggggcctgaggaggctacgcgaccatggtgcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggagctggacaatcacggccggcgactgctcctcagtgaggaggcgtcactcaatatccctgcagtggcggccgcccatgtgatcaaacggtatacagcccaggcgccagatgagctgtcctttgaggtgggagacattgtctcggtgatcgacatgccacccacagaggatcggagctggtggcggggcaagcgaggcttccaggtcgggttcttccccagtgagtgtgtggaactcttcacagagcggccaggtccgggcctgaaggcggatgccgatggccccccatgtggcatcccggctccccagggtatctcgtctctgacctcagctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatgtgccccaggtgctgcgctgctgctccgagttcattgaggcccacggggtggtggatgggatctaccggctctcaggcgtgtcttccaacatccagaggcttcggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcaccccccgcccctgcctctgccttcccacccagggtgaccccccaggccatctcgccccgggggcccaccagccccgcctcgcctgctgccctagacatctcagagcccctggctgtatcagtgccacccgctgtcctagaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccaggtcagtgcgcagctcagggcaggtggcgggggcagggatgcgccagaggcagcagcccagtccccatgttctgtcccctcacaggttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggccccacccgctcctggagtccctttcgctccatgccccccgacaggctcaatgcctcctacggcatgcttggccaatcacccccactccacaggtcccccgacttcctgctcagctacccgccagccccctcctgctttccccctgaccaccttggctactcagccccccagcaccctgctcggcgccctacaccgcctgagcccctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacagggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctccctccaggagcccccagcatgtcctgacctgtgcacggggatggggggacaactcctacccttctttccccacatgccccactaaaccatctgacaacattaatgaataaaatggtgaaaatgtgaaaaaaaaagt

SEQ ID NO: 305514 - DNA, 3533 bp, Homo sapiens
  misc_feature (127)..(127): n is a, c, g, or t
cggcgcggggatggacggccccggggccagcgccgtggtcgtgcgcgtcggcatcccggacctgcagcagacgaagtgcctgcgcctggacccggccgcgcccgtgtgggccgccaagcagcgcgtngctctgcgccctcaaccacagcctccaggacgcgctcaactatgggcttttccagccgccctcccggggccgcgccggcaagttcctggatgaggagcggctcctgcaggagtacccgcccaacctggacacgcccctgccctacctggagtttcgatacaagcggcgagtttatgcccagaacctcatcgatgataagcagtttgcaaagcttcacacaaaggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcaccccccgcccctgcctctgccttcccacccagggtgaccccccaggccatctcgccccgggggcccaccagccccgcctcgcctgctgccctagacatctcagagcccctggctgtatcagtgccacccgctgtcctagaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccaggtcagtgcgcagctcagggcaggtggcgggggcagggatgcgccagaggcagcagcccagtccccatgttctgtcccctcacaggttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggccccacccgctcctggagtccctttcgctccatgccccccgacaggctcaatgcctcctacggcatgcttggccaatcacccccactccacaggtcccccgacttcctgctcagctacccgccagccccctcctgctttccccctgaccaccttggctactcagccccccagcaccctgctcggcgccctacaccgcctgagcccctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacagggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctccctccaggagcccccagcatgtcctgacctgtgcacggggatggggggacaactcctacccttctttccccacatgccccactaaaccatctgacaacattaatgaataaaatggtgaaaatgtgaaaaaaaaagt

SEQ ID NO: 305515 - DNA, 2600 bp, Homo sapiens
tgggcggcccagagctgacagctgccccctttccacactccccaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcaccccccgcccctgcctctgccttcccacccagggtgaccccccaggccatctcgccccgggggcccaccagccccgcctcgcctgctgccctagacatctcagagcccctggctgtatcagtgccacccgctgtcctagaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccaggtcagtgcgcagctcagggcaggtggcgggggcagggatgcgccagaggcagcagcccagtccccatgttctgtcccctcacaggttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggccccacccgctcctggagtccctttcgctccatgccccccgacaggctcaatgcctcctacggcatgcttggccaatcacccccactccacaggtcccccgacttcctgctcagctacccgccagccccctcctgctttccccctgaccaccttggctactcagccccccagcaccctgctcggcgccctacaccgcctgagcccctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacagggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctccctccaggagcccccagcatgtcctgacctgtgcacggggatggggggacaactcctacccttctttccccacatgccccactaaaccatctgacaacattaatgaataaaatggtgaaaatgtgaaaaaaaaagt

SEQ ID NO: 305516 - DNA, 4329 bp, Homo sapiens
  misc_feature (4299)..(4299): n is a, c, g, or t
gccatggcggcggcagcggcgacgagaacggcgagcgaggggtcgagcgcggccggggcctgaggaggctacgcgaccatggtgcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggagctggacaatcacggccggcgactgctcctcagtgaggaggcgtcactcaatatccctgcagtggcggccgcccatgtgatcaaacggtatacagcccaggcgccagatgagctgtcctttgaggtgggagacattgtctcggtgatcgacatgccacccacagaggatcggagctggtggcggggcaagcgaggcttccaggtcgggttcttccccagtgagtgtgtggaactcttcacagagcggccaggtccgggcctgaaggcggatgccgatggccccccatgtggcatcccggctccccagggtatctcgtctctgacctcagctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatgtgccccaggtgctgcgctgctgctccgagttcattgaggcccacggggtggtggatgggatctaccggctctcaggcgtgtcttccaacatccagaggcttcggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcaccccccgcccctgcctctgccttcccacccagggtgaccccccaggccatctcgccccgggggcccaccagccccgcctcgcctgctgccctagacatctcagagcccctggctgtatcagtgccacccgctgtcctagaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccaggtcagtgcgcagctcagggcaggtggcgggggcagggatgcgccagaggcagcagcccagtccccatgttctgtcccctcacaggttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggccccacccgctcctggagtccctttcgctccatgccccccgacaggctcaatgcctcctacggcatgcttggccaatcacccccactccacaggtcccccgacttcctgctcagctacccgccagccccctcctgctttccccctgaccaccttggctactcagccccccagcaccctgctcggcgccctacaccgcctgagcccctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacagggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctccctccaggagcccccagcatgtcctgacctgtgcacggggatggggggacaactcctacccttggctacaacatccccctatgccagcagggcggcnttgatgaatgaaaaggtgattgtgtgcgaa

SEQ ID NO: 305517 - DNA, 3716 bp, Homo sapiens
gccatggcggcggcagcggcgacgagaacggcgagcgaggggtcgagcgcggccggggcctgaggaggctacgcgaccatggtgcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggagctggacaatcacggccggcgactgctcctcagtgaggaggcgtcactcaatatccctgcagtggcggccgcccatgtgatcaaacggtatacagcccaggcgccagatgagctgtcctttgaggtgggagacattgtctcggtgatcgacatgccacccacagaggatcggagctggtggcggggcaagcgaggcttccaggtcgggttcttccccagtgagtgtgtggaactcttcacagagcggccaggtccgggcctgaaggcggatgccgatggccccccatgtggcatcccggctccccagggtatctcgtctctgacctcagctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatgtgccccaggtgctgcgctgctgctccgagttcattgaggcccacggggtggtggatgggatctaccggctctcaggcgtgtcttccaacatccagaggcttcggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcaccccccgcccctgcctctgccttcccacccagggtgaccccccaggccatctcgccccgggggcccaccagccccgcctcgcctgctgccctagacatctcagagcccctggctgtatcagtgccacccgctgtcctagaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgcacctagcatcactcggcacggacaccatgcgccctgacgcatctgtcagcccgcgcaagagcgctgactacacgcgtagacacactgatagtaccgtgagccgacaccatctagacgcaggtccgaccatatagcacactgtgaccgcttcagcccccatcggaactagcactaatgcgggcatcacacccacgtgaggcataccaccaccacatactcatgccaacaaccaagcacgagcacagactcatatcatctacgactacgagcaaagacaaactaaccgaaccagaagacccacccagtaaacagcagaagacacgatcacgcaccagaccacctctaaacctagtaacagcacaacggcgcacccaccagccccgcaccgaccagccggcacgcacacgcacccgcagacccaccgacccaccgccacacccgcaacgcccgcgacaccccggaccgcagagccccgcacccccacacccacggaccgggcgcccagccggcaggccggccgccaccgcgcaaccacagagacgcaacccgagcccacagacaacgcacgacccaagacgccaagcctcgacgagcacgcacagcccgcgaccgcaggcgacggcgcccggagcgcgcccccacgagaggcgagccaggggagccgaacacgaaagcagagccgcagacagcagaaaagacgcagacacgacacagcgacacgcacaacgagcgccgacgacagaacgcaaaccgcgccggcacaacgaacaaaaagactacaaggacaacaaaggcacctacatatattcgacgcaaacagacagaaactacaacatcaagaaaaacacagacgaacaaacacccacgtaccagcaaacgtagcagaagctagagatcaccaccacagcgacagacacacaacatgcttcatcaaacaaggagaatagaataaacacaaacagaacggataagcagaaagcgtggatcaaaagtaaaaacataaaaagacgagcaaaccga

SEQ ID NO: 305518 - DNA, 2094 bp, Homo sapiens
gccatggcggcggcagcggcgacgagaacggcgagcgaggggtcgagcgcggccggggcctgaggaggctacgcgaccatggtgcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggagctggacaatcacggccggcgactgctcctcagtgaggaggcgtcactcaatatccctgcagtggcggccgcccatgtgatcaaacggtatacagcccaggcgccagatgagctgtcctttgaggtgggagacattgtctcggtgatcgacatgccacccacagaggatcggagctggtggcggggcaagcgaggcttccaggtcgggttcttccccagtgagtgtgtggaactcttcacagagcggccaggtccgggcctgaaggcggatgccgatggccccccatgtggcatcccggctccccagggtatctcgtctctgacctcagctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatgtgccccaggtgctgcgctgctgctccgagttcattgaggcccacggggtggtggatgggatctaccggctctcaggcgtgtcttccaacatccagaggcttcggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggtgagtgggatgctgggggtggcgaggggcaggtggaggcctggttcctcagacggcctcctgtttctcccccaaaccgcaggaggaaaggggagagaggggagaagcagcggaagccagggggcagcagctggaagacgttctttgcactgggccggggccccagtgtcccaggagcccccagcatgtcctgacctgtgcacggggatggggggacaactcctacccttctttccccacatgccccactaaaccatctgacaacattaatgaataaaatggtgaaaatgtgaaaaaaaaagt

SEQ ID NO: 305519 - DNA, 741 bp, Homo sapiens
atgctctcgttgtctctttgctcccatctctgggggcctctgattctttctgctctacaggcacgcagcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggaggtgggcctgggcagggggcttggagattccgagtgggtgagggggtgcgtgtgccaccacgcccagcacagagagattttagatggcaaccgtgtggcatctgctgtggaggatgaaggtgcagaggtggatggggaagccttcaggtggggaagcctttgggtgggagagtcctgggacatgtga

SEQ ID NO: 305520 - DNA, 4308 bp, Homo sapiens
cgattgaagtggctgaggcgttgaatggcccggaggcgttgaatggcccggaggcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggagctggacaatcacggccggcgactgctcctcagtgaggaggcgtcactcaatatccctgcagtggcggccgcccatgtgatcaaacggtatacagcccaggcgccagatgagctgtcctttgaggtgggagacattgtctcggtgatcgacatgccacccacagaggatcggagctggtggcggggcaagcgaggcttccaggtcgggttcttccccagtgagtgtgtggaactcttcacagagcggccaggtccgggcctgaaggcggatgccgatggccccccatgtggcatcccggctccccagggtatctcgtctctgacctcagctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatgtgccccaggtgctgcgctgctgctccgagttcattgaggcccacggggtggtggatgggatctaccggctctcaggcgtgtcttccaacatccagaggcttcggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcaccccccgcccctgcctctgccttcccacccagggtgaccccccaggccatctcgccccgggggcccaccagccccgcctcgcctgctgccctagacatctcagagcccctggctgtatcagtgccacccgctgtcctagaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccaggtcagtgcgcagctcagggcaggtggcgggggcagggatgcgccagaggcagcagcccagtccccatgttctgtcccctcacaggttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggccccacccgctcctggagtccctttcgctccatgccccccgacaggctcaatgcctcctacggcatgcttggccaatcacccccactccacaggtcccccgacttcctgctcagctacccgccagccccctcctgctttccccctgaccaccttggctactcagccccccagcaccctgctcggcgccctacaccgcctgagcccctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacagggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctccctccaggagcccccagcatgtcctgacctgtgcacggggatggggggacaactcctacccttctttccccacatgccccactaaaccatctgacaacattaatgaataaaatggtgaaaatgtgaaaaaaaaagt

SEQ ID NO: 305521 - DNA, 4254 bp, Homo sapiens
gccatggcggcggcagcggcgacgagaacggcgagcgaggggtcgagcgcggccggggcctgaggaggctacgcgaccatggtgcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggagctggacaatcacggccggcgactgctcctcagtgaggaggcgtcactcaatatccctgcagtggcggccgcccatgtgatcaaacggtatacagcccaggcgccagatgagctgtcctttgaggtgggagacattgtctcggtgatcgacatgccacccacagaggatcggagctggtggcggggcaagcgaggcttccaggtcgggttcttccccagtgagtgtgtggaactcttcacagagcggccaggtccgggcctgaaggcggatgccgatggccccccatgtggcatcccggctccccagggtatctcgtctctgacctcagctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatgtgccccaggtgctgcgctgctgctccgagttcattgaggcccacggggtggtggatgggatctaccggctctcaggcgtgtcttccaacatccagaggcttcggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcaccccccgcccctgcctctgccttcccacccagggtgaccccccaggccatctcgccccgggggcccaccagccccgcctcgcctgctgccctagacatctcagagcccctggctgtatcagtgccacccgctgtcctagaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccaggttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggccccacccgctcctggagtccctttcgctccatgccccccgacaggctcaatgcctcctacggcatgcttggccaatcacccccactccacaggtcccccgacttcctgctcagctacccgccagccccctcctgctttccccctgaccaccttggctactcagccccccagcaccctgctcggcgccctacaccgcctgagcccctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacagggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctccctccaggagcccccagcatgtcctgacctgtgcacggggatggggggacaactcctacccttctttccccacatgccccactaaaccatctgacaacattaatgaataaaatggtgaaaatgtgaaaaaaaaagt

SEQ ID NO: 305522 - DNA, 3196 bp, Homo sapiens
gccatggcggcggcagcggcgacgagaacggcgagcgaggggtcgagcgcggccggggcctgaggaggctacgcgaccatggtgcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggagctggacaatcacggccggcgactgctcctcagtgaggaggcgtcactcaatatccctgcagtggcggccgcccatgtgatcaaacggtatacagcccaggcgccagatgagctgtcctttgaggtgggagacattgtctcggtgatcgacatgccacccacagaggatcggagctggtggcggggcaagcgaggcttccaggtcgggttcttccccagtgagtgtgtggaactcttcacagagcggccaggtccgggcctgaaggcggatgccgatggccccccatgtggcatcccggctccccagggtatctcgtctctgacctcagctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatgtgccccaggtgctgcgctgctgctccgagttcattgaggcccacggggtggtggatgggatctaccggctctcaggcgtgtcttccaacatccagaggcttcggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcaccccccgcccctgcctctgccttcccacccagggtgaccccccaggccatctcgccccgggggcccaccagccccgcctcgcctgctgccctagacatctcagagcccctggctgtatcagtgccacccgctgtcctagaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccagcaggagcccccagcatgtcctgacctgtgcacggggatggggggacaactcctacccttctttccccacatgccccactaaaccatctgacaacattaatgaataaaatggtgaaaatgtgaaaaaaaaagt

SEQ ID NO: 305523 - DNA, 1684 bp, Homo sapiens
gccatggcggcggcagcggcgacgagaacggcgagcgaggggtcgagcgcggccggggcctgaggaggctacgcgaccatggtgcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggagctggacaatcacggccggcgactgctcctcagtgaggaggcgtcactcaatatccctgcagtggcggccgcccatgtgatcaaacggtatacagcccaggcgccagatgagctgtcctttgaggtgggagacattgtctcggtgatcgacatgccacccacagaggatcggagctggtggcggggcaagcgaggcttccaggtcgggttcttccccagtgagtgtgtggaactcttcacagagcggccaggtccgggcctgaaggcggatgccgatggccccccatgtggcatcccggctccccagggtatctcgtctctgacctcagctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatgtgccccaggtgctgcgctgctgctccgagttcattgaggcccacggggtggtggatgggatctaccggctctcaggcgtgtcttccaacatccagaggcttcggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcagctcctccgctcaggattcccacctcttggcccggacgccgctcttcc

SEQ ID NO: 305524 - DNA, 2324 bp, Homo sapiens
ggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggccgtgtcccgtgccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305525 - DNA, 515 bp, Homo sapiens
  misc_feature (14)..(14): n is a, c, g, or t
aatattgtaatggnaaggcccttgggttggcaatttaatgcaagcaatttccaaaaaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305526 - DNA, 841 bp, Homo sapiens
  misc_feature (786)..(787): n is a, c, g, or t
  misc_feature (792)..(792): n is a, c, g, or t
ctgagcatactgtataaaacaattaagaggactggtcacaacacgtgtaattaagtagtacttcctctctccgtctctttatatagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataataannaacanacaaaaaacaaacaccagaggatcacaactacgggtgaagtaacacacg

SEQ ID NO: 305527 - DNA, 929 bp, Homo sapiens
  misc_feature (18)..(18): n is a, c, g, or t
  misc_feature (20)..(20): n is a, c, g, or t
aaactaggctaggagagncnggggtaatcggccgagggaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagaactaaacagatgagaaagtattatttcattccagcgtatgtggggacccaccatgttgatgggggctcgaatcggattgttgaagcgcggggactggcttgaaaaggctggtggggcatgggtgctccttggaaaaatggggcgttaacaggggggggcgcccagaacagggttccaagacgcggagccccatg

SEQ ID NO: 305528 - DNA, 695 bp, Homo sapiens
ggccggggagccgttggggaggccctggcggccgcgcagcaggtgcaggggcgcagagcctgggctcgccttggtacagacgagcgggccccggccttggcgccttcagtttccttccagtttttattttcgctgtgtctacagagcagatgacaccaatttggaaacccgcgagagtgggtagagctaagatagtcttgctgtagtagctgtgatattagatgctcggccatgacttagaggtgtttatttaaggactgtgaatgactcggtgatttcggaaaagcttggcttagatgaacggacatacacaggggagacagccctaaggtttgcagaaaaggctgattgtgctgtttgcgaagtcgaaataattggtgaaagtgtagaaggcagaacctctcaggaatgtctggggaggacaaagaatgtgttggctgactttgtttaaacataaaattgggcagactttaattgatttgtgaaatttttttcaaagtttgtttgaattagcccctatctcttctaacattatcctcttgtgctaattgattgaccattttaaataacttagctgttacagaaagaccgaaaggtgttcttcagtaaaatatattcaagtaagttacttaagtaacgccttaaaagatacagaaaagcaaaaaagtattggcgtattaaaaagaaatcaaaac

SEQ ID NO: 305529 - DNA, 248 bp, Homo sapiens
tatttagaacaggattgtttttattttaattgtggctataagtgaacatctatcatgagacatttgctgcactttccttgcttgtaggttggttttgcggattgccactgatgattccaaagcagtctgtcgtctcagtgtgaaattcggtgccacgctcagaaccagcaggctccttttggaacgggcgaaagagctaaatatcgatgttgttggtgtcaggtgagattttggtgggatagctagag

SEQ ID NO: 305530 - DNA, 2025 bp, Homo sapiens
ggccggggagccgttggggaggccctggcggccgcgcagcaggtgcaggggcgcagagcctgggctcgccttggtacagacgagcgggccccggccttggcgccttcagtttccttccagtttttattttcgctgtgtctacagagcagatgacaccaatttggaaacccgcgagaattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305531 - DNA, 2106 bp, Homo sapiens
  misc_feature (235)..(235): n is a, c, g, or t
cactgtcgtgctctgcgcgtgccgcgtcgtagccgaagcgatactcgcggactgccaccatcgggtccctggcgtgtcttccgcgtggaggccgaggtgtccatgtgctgcctgacggtggctgcgagtcgtgggcgcggtgctcgacgtagtcatccgtaggctcggcttagttgaacttcacggactacacgcgcaggtgttgacgcctttgccctaatagtgagactgggcntgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305532 - DNA, 1900 bp, Homo sapiens
gcaggccagccccatggggaagcgcagacgccggagcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305533 - DNA, 1835 bp, Homo sapiens
  misc_feature (18)..(18): n is a, c, g, or t
  misc_feature (20)..(20): n is a, c, g, or t
aaactaggctaggagagncnggggtaatcggccgagggagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305534 - DNA, 2220 bp, Homo sapiens
  misc_feature (3)..(3): n is a, c, g, or t
  misc_feature (223)..(223): n is a, c, g, or t
  misc_feature (225)..(225): n is a, c, g, or t
ctnaaacttgcatgctagatttttttggtacaaatatttgaaatgcttagtgtgctgccttggaaaaacctggtattttttgttgtgtccttatactgccaaggtttatggaatcatgtaccttatgcctagtaataattaggatgacaggcagtgagtggttcatatccggggcatgattagctctgcgtgtgctcagccagtgccccatcttcaactcgangngttcctaaggtagacagcaaattccctattttatttctcagattgtcactgctgttccaagggcacacgcagagggatttggaattcctggagagttgcctttgtgagaagctggaaatatttctttcaattccatctcttagttttccatgtaagtattcagtttacatttatgttgcaggttaatcttaagaattgtattgctaaggcttctaagtgaatttctccactctatttgcattttgttgcatttcagaggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305535 - DNA, 2745 bp, Homo sapiens
ggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggccgtgtcccgtgccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataaattaggcattgggacgtttttatggtgtgttcattccagacagttcacgaatcccgtatagctcgctctgattctcagagaacaatgagtgggtccacccacacacaggtaggaggacaggtgagacggaagccccatcctcccatgtggacggtgcacatctgctcagcccaccccacatgtccagagttggctgcaaactccttgtccagagcctctggtggtgggacctacttaagtctgacggacctgtcctgtccaggccagtgcccagggaaggtgtgggaggccctttgagcctggcctgcagagaccatccgtgtcccctcccaccttcatgcctgtgagaagttaggaatgtatacggtaccacatttggcagtcagcttattttaataaattcagcaacagcaagtcccta

SEQ ID NO: 305536 - DNA, 2383 bp, Homo sapiens
  misc_feature (2328)..(2329): n is a, c, g, or t
  misc_feature (2334)..(2334): n is a, c, g, or t
ggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggccgtgtcccgtgccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataataannaacanacaaaaaacaaacaccagaggatcacaactacgggtgaagtaacacacg

SEQ ID NO: 305537 - DNA, 2787 bp, Homo sapiens
ggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggccgtgtcccgtgccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataaaaaaaaaaaaaaaaaaaaaaaaaaaaaaaaaaaaaaaaaaaaaaaaaaaaaaaaaaaaaaaaaaaaaaaataataaaaaaaaaaaaaaaaaaaaataaaaaaaaaaggggataaaaaaaaaaaaaaaaaaaaaaaaatacttgcggcccctttgccccacatgctcttaactcttgctagttttttcattatgggccaatttgggtcctatttggacaattccccctttgggggggcagtttacaaatgaagggcccgtttttaaaaaacggtgtttggggaaaacccggggggatcccaaatataatgtctttggagaaaaacctttatgtgcaggtgggattatatggaaagggccccaaccggcggctttttaaaaaatttggcaaacccaaaaggcgaagggaattttgaaggccttaatttgggaaaaatcccgggaaaattttttgaaaatcgcctt

SEQ ID NO: 305538 - DNA, 2389 bp, Homo sapiens
  misc_feature (2336)..(2336): n is a, c, g, or t
  misc_feature (2339)..(2339): n is a, c, g, or t
  misc_feature (2342)..(2342): n is a, c, g, or t
  misc_feature (2376)..(2376): n is a, c, g, or t
ggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggccgtgtcccgtgccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataaaaaccgatgcgnccnccnccccggtggagtccagctttgtcccttatgaggngcaggcgaagggg

SEQ ID NO: 305539 - DNA, 2362 bp, Homo sapiens
  misc_feature (1520)..(1521): n is a, c, g, or t
ggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggccgtgtcccgtgccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaacgttatttacacaacggggggggaacaacaggacgnnggctctggaaattgggaaaccgggggaaaaggacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305540 - DNA, 1621 bp, Homo sapiens
  misc_feature (4)..(4): n is a, c, g, or t
  misc_feature (21)..(21): n is a, c, g, or t
  misc_feature (23)..(23): n is a, c, g, or t
  misc_feature (38)..(38): n is a, c, g, or t
tcanagcagtacgaggctggngntgaatcggccgaggnacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305541 - DNA, 2224 bp, Homo sapiens
ggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggccgtgtcccgtgccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttcttcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305542 - DNA, 2693 bp, Homo sapiens
ggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggccgtgtcccgtgccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctatatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataaaaaaaaaaaaaaaaaaaaaaaaaaaaaaaaaaaaaaaaaaaaaaaaaaaaaaaaaaaaaaaaaaaaaaaataataaaaaaaaaaaaaaaaaaaaataaaaaaaaaaggggataaaaaaaaaaaaaaaaaaaaaaaaatacttgcggcccctttgccccacatgctcttaactcttgctagttttttcattatgggccaatttgggtcctatttggacaattccccctttgggggggcagtttacaaatgaagggcccgtttttaaaaaacggtgtttggggaaaacccggggggatcccaaatataatgtctttggagaaaaacctttatgtgcaggtgggattatatggaaagggccccaaccggcggctttttaaaaaatttggcaaacccaaaaggcgaagggaattttgaaggccttaatttgggaaaaatcccgggaaaattttttgaaaatcgcctt

SEQ ID NO: 305543 - DNA, 1429 bp, Homo sapiens
tggcaggtcgaggcggggtggtgtaatcggcacgagggcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305544 - DNA, 1404 bp, Homo sapiens
  misc_feature (4)..(4): n is a, c, g, or t
  misc_feature (21)..(21): n is a, c, g, or t
  misc_feature (23)..(23): n is a, c, g, or t
  misc_feature (38)..(38): n is a, c, g, or t
tcanagcagtacgaggctggngntgaatcggccgaggnaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305545 - DNA, 2355 bp, Homo sapiens
ggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggccgtgtcccgtgccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggtaagtaagccatgcatgttgatggtgctgccaagaataggcaccttcttggatgtgtgcttcttgtctagacgaataagaaattgtcttgcctaagattaaatatatatggatatttttcctaagaaaagttttagaaaagactgatgagtgtatttctatgtaattggaatatatttaagttcatgccatgtgtcttgtggtttccttattaccaaaacggtgactgaagaaacgcttgctttagaaatacattgaattggccaggtgtgctggctcacacctgaaatcacaacacattgggaggccaaggcagaaggatcacttgagcccaggagttcgagcctgggcaacatagtgagaccctgtctctacaaaaaattaaaaaattagttggccatggtagtgggcgcctgtagtcccagctgcttggctaaggtgagaggtttgcttgagcctgggaggttgaggctgcggtgagctatgatagcaccattgtattccagcctgag

SEQ ID NO: 305546 - DNA, 1977 bp, Homo sapiens
ggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggccgtgtcccgtgccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305547 - DNA, 1360 bp, Homo sapiens
tatttagaacaggattgtttttattttaattgtggctataagtgaacatctatcatgagacatttgctgcactttccttgcttgtaggttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305548 - DNA, 1698 bp, Homo sapiens
  misc_feature (1521)..(1521): n is a, c, g, or t
  misc_feature (1524)..(1524): n is a, c, g, or t
  misc_feature (1526)..(1526): n is a, c, g, or t
  misc_feature (1530)..(1530): n is a, c, g, or t
  misc_feature (1532)..(1532): n is a, c, g, or t
  misc_feature (1535)..(1536): n is a, c, g, or t
ggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggccgtgtcccgtgccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatggtgcanaangntcgngnggnnttgttttggaggaggggcatgggactaatgggcatcttgaccgcattagcctctggaaagaaccgaagagttttcccttggggcgttttccccagttgggcggcgccgggtgggccaaaagggggcgcctccagcacaatatggggggaacccccacgccgt

SEQ ID NO: 305549 - DNA, 1631 bp, Homo sapiens
ggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggccgtgtcccgtgccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatggctcgagtggccaacataattcgcggggcccacccttttttaacgcggaaaagggaaaggacactacaggatgatttttacaccctttataaccctgtgaaaacatccccagaatt

SEQ ID NO: 305550 - DNA, 1665 bp, Homo sapiens
  misc_feature (1489)..(1489): n is a, c, g, or t
  misc_feature (1502)..(1502): n is a, c, g, or t
ggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggccgtgtcccgtgccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaatgttnacggacgacggcngtagcaaatagtcaggacaactagtcacgtgaggggtcagaggacatgcacttgacgcctaggctgtctaaacagcagataccgttggacatggccagagaccgacccaggcaggcaagcaggcagccaagaattgctcccatcgctaagattattttgtgcg

SEQ ID NO: 305551 - DNA, 865 bp, Homo sapiens
  misc_feature (3)..(3): n is a, c, g, or t
atngcatactctatgaccacgcacataatacataaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305552 - DNA, 782 bp, Homo sapiens
ctgagcatactgtataaaacaattaagaggactggtcacaacacgtgtaattaagtagtacttcctctctccgtctctttatatagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305553 - DNA, 1235 bp, Homo sapiens
  misc_feature (1052)..(1052): n is a, c, g, or t
  misc_feature (1055)..(1055): n is a, c, g, or t
  misc_feature (1059)..(1059): n is a, c, g, or t
  misc_feature (1071)..(1073): n is a, c, g, or t
ggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggccgtgtcccgtgccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaanggnttgnggatgcactgannnttcaaagccggctgtggctcaggtgaaatggtggccgtcagaaccagagggtctttggagggaaagctaattggttggggggggcacgggagggggcggcggaattggggattggccggggttgaaggggggggggcgtttctgttgggggggtgtgggaga

SEQ ID NO: 305554 - DNA, 1198 bp, Homo sapiens
  misc_feature (1064)..(1064): n is a, c, g, or t
  misc_feature (1066)..(1066): n is a, c, g, or t
  misc_feature (1070)..(1070): n is a, c, g, or t
  misc_feature (1079)..(1079): n is a, c, g, or t
  misc_feature (1082)..(1082): n is a, c, g, or t
  misc_feature (1091)..(1092): n is a, c, g, or t
  misc_feature (1099)..(1099): n is a, c, g, or t
  misc_feature (1103)..(1103): n is a, c, g, or t
  misc_feature (1105)..(1105): n is a, c, g, or t
ggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggccgtgtcccgtgccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagtttggggattgncntgangatcaaagngtntggtcgggnnaatgggngcgntnaaacaaggccttggaagggggaaagcaacacggtgtgggccgccgtgaaggggcgcggacggcgaatcggcggggtgatggggagggcatttt

SEQ ID NO: 305555 - DNA, 955 bp, Homo sapiens
ggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggccgtgtcccgtgccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgtaagtatatgaggcccatgctggcagtgcagctgagagtgccaggcaagtggaaaactttggcaaggtctaaggaagagcaatgaggcttacatgtcttgttatggaatgtagaaattaattcactggtggtaaattaatagtgataatggtgatactcatatcagtggctagactcaaaagagcaggattcattgtgactgatgggaatgaaggtcgctggctattggtgtggtgtgtggtgaggctgc

SEQ ID NO: 305556 - DNA, 307 bp, Homo sapiens
ctgactttgtgacttagcgggctgtgttgcctatgtagagaacccgcttcacccccactctggaaagtccagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataa

SEQ ID NO: 305557 - DNA, 351 bp, Homo sapiens
gacacagtgtctcgtctctttattttaccccagcttccatgtaggaagcggctgtaccgatcctgagaccttcgtgcaggcaatctctgatgcccgctgtgtttttgacatgggggtgagtatacgtgaccctgttagggaagggcgggacacaactgacaataactagtcttaattctagagttaactttttatggcagttggttctgtattacatgggtttcagcctatctgctgcatacatttttgttattagctgtggatctggctgacttattttcttgattctaggctgaggttggtttcagcatgtatctgcttgatattggcggtggctttcctggatctgag

SEQ ID NO: 305558 - DNA, 508 bp, Homo sapiens
gtaagcgatagcagcaggcctcaaaagcgttgtataaaatgggcctggtattccccacgaggcagatacaagttgtgttttttgggcaataaatgctcactaaaggcaaatggggcgggggggtacatgacaacttcccatgcttttctgtttattccacgtgttaagccacatatggatagcatgacaccactcttctttttcagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagtgagttattcccccatctgagggcaagatcgggagcataagatatgtggattcttatcaaacaaacttaaatttctgattattatatttctatactttagtagaaagtagttgaaacccccattgagt

SEQ ID NO: 305559 - DNA, 677 bp, Homo sapiens
acaatgaaggctgctctttcttttctgtttcactctcttagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgtggtatgtataaaggacgaatcacttcatgtataactgaaagctgatgcaaaaagtcattaagattgttgatctgcctttctagacgaagatgagtcgagtgagcagacctttatgtattatgtgaatgatggcgtctatggatcatttaattgcatactctatgaccacgcacatgtaaagccccttctgcaaaaggtaatttctgagcatactgtataaaacaattaagaggactggtcacaacacgtgtaattaagtagtacttcctctctccgtctctttatatagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccg

SEQ ID NO: 305560 - DNA, 2844 bp, Homo sapiens
ccgtatgcatggctggaggcaacacagatcaccttgcgaggggctgacatcaagagcgtcgtcttcaaaggtgaaaaaaggcgtggtcacactggggagattggattagatgatgtgagcttgaaaaaaggccactgctctgaagaacgctaacaactccagaactaacaatgaactcctatgttgctctatcctctttttccaattctcatcttctctcctcttctcccttttatcaggcctaggagaagagtgggtcagtgggtcagaaggaagtctatttggtgacccaggtttttctggcctgcttttgtgcaatcccaatgaacagtgataccctccttgaaatacaggggcatcgcagacacatcaaagccatctgtgggtgttgccttccatcctgtgtctctttcaggaaggcattcagcatgcgtgagccataccatcctccatcctgattacaaggtgctccttgtagcaaattatgagagtgagttacgggagcagtttttaaaagaaatctttgcagatggctatgatgttatgtgttcggtgttgtaccatgagtagtattgacttcccttgagatatgatgtacaatgtgcttgtgaaattgacttaccctcttcacttaagttagttctggcctgacctgaactctgacttttactgccattcactttataaaataagggtgtgtaacatatcaagatacatttatttttatctgttttttttttcctgttaaagacaattatgtagagtgggcacgtaatccctccttagtagtattgtgttttgtgtaaatgtgctattgatattaagtatttacatgttccaaatatttacagactctagttgcaaggtaaagggcagcttgtgatctcaaaaaaatacatggtgaaatgtcatccagttccatgaccttatattggcagcagtaggaaattggcagaagtgttgggttgtggtaacggagtgatgaatttttttttaatggccttgagtttgatctctgcaaaggataggaaacctttaggaagacaagaaactgcagttaatttagaactgtcactgtttcaagttacactttaaaaccacagcttttaccatcataacatggctctggtaatatgtaggaagctttataaaagttttggttgattcagaaaaaggatcctgttgcagagtgagaggaagcatagggggaaactccattggaacagattttcacacaacgttttaaattgatataagtttaggcagttgtagttcataacttatgttgctcatgttgtgctgtgtcaggatgggataggaagcaagtcccatgcttagaggcatgggatgtgttggaacgggatttacacacactggaggagcagggcaagttggaattctaagatccatgaacccccaactgtatttcctccctgcatattttaccaatatattaaaaaacaatgtaacttttaaaaggcatcattcctgaggtttgtcttaatttctgattaagtaatcagaatattttctgctgtttttgccaggaatcacaaagatgattaaagggttggaaaaaaagatctatgatggaaaattaaaggaactgggattattgagcctggagaagagaagactgaggggcaaaccattgatggttttcaagtatatgaagggttggcacagagagggtggcgaccagctgttctccatatgcactaagaatagaacaagaggaaactggcttagactagagtataagggagcatttcttggcaggggccattgttagaatacttcataaaaaaagaagtgtgaaaatctcagtatctctctctctttctaaaaaattagataaaaatttgtctatttaagatggttaaagatgttcttacccaaggaaaagtaacaaattatagaatttcccaaaagatgttttgatcctactagtagtatgcagtgaaaatctttagaactaaataatttggacaaggcttaatttaggcatttccctcttgacctcctaatggagagggattgaaaggggaagagcccaccaaatgctgagctcactgaaatatctctcccttatggcaatcctagcagtattaaagaaaaaaggaaactatttattccaaatgagagtatgatggacagatattttagtatctcagtaatgtcctagtgtggcggtggttttcaatgtttcttcatggtaaaggtataagcctttcatttgttcaatggatgatgtttcagatttttttttttttaagagatccttcaaggaacacagttcagagagattttcatcgggtgcattctctctgcttcgtgtgtgacaagttatcttggctgctgagaaagagtgccctgccccacaccggcagacctttccttcacctcatcagtatgattcagtttctcttatcaattggactctcccaggttccacagaacagtaatattttttgaacaataggtacaatagaaggtcttctgtcatttaacctggtaaaggcagggctggagggggaaaataaatcattaagcctttgagtaacggcagaatatatggctgtagatccatttttaatggttcatttcctttatggtcatataactgcacagctgaagatgaaaggggaaaataaatgaaaattttacttttcgatgccaatgatacattgcactaaactgatggaagaagttatccaaagtactgtataacatcttgtttattatttaatgttttctaaaataaaaaatgttagtggttttccaaatggcctaataaaaacaattatttgtaaataaaaacactgttagtaataaaaaaaaaaa

SEQ ID NO: 305561 - DNA, 2792 bp, Homo sapiens
ccgtatgcatggctggaggcaacacagatcaccttgcgaggggctgacatcaagagcgtcgtcttcaaaggtgaaaaaaggcgtggtcacactggggagattggattagatgatgtgagcttgaaaaaaggccactgctctgaagaacgctaacaactccagaactaacaatgaactcctatgttgctctatcctctttttccaattctcatcttctctcctcttctcccttttatcaggcctaggagaagagtgggtcagtgggtcagaaggaagtctatttggtgacccaggtttttctggcctgcttttgtgcaatcccaatgaacagtgataccctccttgaaatacaggggcatcgcagacacatcaaagccatctgtgggtgttgccttccatcctgtgtctctttcaggaaggcattcagcatgcgtgagccataccatcctccatcctgattacaaggtgctccttgtagcaaattatgagagtgagttacgggagcagtttttaaaagaaatctttgcagatggctatgatgttatgtgttcggtgttgtaccatgagtagtattgacttcccttgagatatgatgtacaatgtgcttgtgaaattgacttaccctcttcacttaagttagttctggcctgacctgaactctgacttttactgccattcactttataaaataagggtgtgtaacatatcaagatacatttatttttatctgttttttttttcctgttaaagacaattatgtagagtgggcacgtaatccctccttagtagtattgtgttttgtgtaaatgtgctattgatattaagtatttacatgttccaaatatttacagactctagttgcaaggtaaagggcagcttgtgatctcaaaaaaatacatggtgaaatgtcatccagttccatgaccttatattggcagcagtaggaaattggcagaagtgttgggttgtggtaacggagtgatgaatttttttttaatggccttgagtttgatctctgcaaaggataggaaacctttaggaagacaagaaactgcagttaatttagaactgtcactgtttcaagttacactttaaaaccacagcttttaccatcataacatggctctggtaatatgtaggaagctttataaaagttttggttgattcagaaaaaggatcctgttgcagagtgagaggaagcatagggggaaactccattggaacagattttcacacaacgttttaaattgatataagtttaggcagttgtagttcataacttatgttgctcatgttgtgctgtgtcaggatgggataggaagcaagtcccatgcttagaggcatgggatgtgttggaacgggatttacacacactggaggagcagggcaagttggaattctaagatccatgaacccccaactgtatttcctccctgcatattttaccaatatattaaaaaacaatgtaacttttaaaaggcatcattcctgaggtttgtcttaatttctgattaagtaatcagaatattttctgctgtttttgccaggaatcacaaagatgattaaagggttggaaaaaaagatctatgatggaaaattaaaggaactgggattattgagcctggagaagagaagactgaggggcaaaccattgatggttttcaagtatatgaagggttggcacagagagggtggcgaccagctgttctccatatgcactaagaatagaacaagaggaaactggcttagactagagtataagggagcatttcttggcaggggccattgttagaatacttcataaaaaaagaagtgtgaaaatctcagtatctctctctctttctaaaaaattagataaaaatttgtctatttaagatggttaaagatgttcttacccaaggaaaagtaacaaattatagaatttcccaaaagatgttttgatcctactagtagtatgcagtgaaaatctttagaactaaataatttggacaaggcttaatttaggcatttccctcttgacctcctaatggagagggattgaaaggggaagagcccaccaaatgctgagctcactgaaatatctctcccttatgtatgatggacagatattttagtatctcagtaatgtcctagtgtggcggtggttttcaatgtttcttcatggtaaaggtataagcctttcatttgttcaatggatgatgtttcagatttttttttttttaagagatccttcaaggaacacagttcagagagattttcatcgggtgcattctctctgcttcgtgtgtgacaagttatcttggctgctgagaaagagtgccctgccccacaccggcagacctttccttcacctcatcagtatgattcagtttctcttatcaattggactctcccaggttccacagaacagtaatattttttgaacaataggtacaatagaaggtcttctgtcatttaacctggtaaaggcagggctggagggggaaaataaatcattaagcctttgagtaacggcagaatatatggctgtagatccatttttaatggttcatttcctttatggtcatataactgcacagctgaagatgaaaggggaaaataaatgaaaattttacttttcgatgccaatgatacattgcactaaactgatggaagaagttatccaaagtactgtataacatcttgtttattatttaatgttttctaaaataaaaaatgttagtggttttccaaatggcctaataaaaacaattatttgtaaataaaaacactgttagtaataaaaaaaaaaa

SEQ ID NO: 305562 - DNA, 2329 bp, Homo sapiens
ctcggttcaggttccggggcgccgcagagctgccggcctctggaccgcgcgcggcgctctggggaatccggcgccacgcgccgtgcggtggccaggatggaggaggccggagcagcggtggtcacggccggggaggccgaactgaactggtcccgcctcagcgtgtccaccgagacgctggagtctgagctggaggcgcggggggaggagcggcgcggggcgcgggaggcgctgctgcggctgctgctgcctcacaaccgtctggtgtcgctgccacgggcgctgggcagcggcttcccgcacctccagctgctggacgtgagcggcaacgcgttgaccgcgctcgggccggagctgctcgctctgcgcggcctgcgcacgctgctggccaagaacaaccggctcggcgggcccagtgcgctgcccaagggcctggcccagtcgccgctctgccgcagcctccaggtgctcaacctcagcggcaactgtttccaggaggtgcctgcctcgctcttagagctgcgcgcgctgcagaccctgagcctgggcggcaaccaactgcagagcatcccggctgagatcgagaacttgcagagtttagagtgtttatatcttggaggaaatttcattaaagaaatcccaccagaattaggaaatctgccttctctgaattatttggtattatgtgacaacaaaatccaaagcatacctcctcaactttcacagttacattcacttcgttccctaagtcttcacaataacttgctgacatatctgcctcgagagatcctcaaccttattcatttggaagagttgagtttacgaggaaatccattggttgttcgttttgttagagatttaacctatgatcctccaactctcctggaattagctgcacggaccattaagattcgaaatatttcctacactccctatgatcttcctggaaatcttcttagatacttgggttcagccagcaattgcccaaacccaaagtgtggaggagtctactttgactgctgtgtcagacaaattaaatttgtggacttctgtgggaagtatcgcctcccactgatgcactacttgtgttcaccagaatgttcttccccttgcagttctgcctctcacagctccacttcccagagtgaatctgactcagaagatgaagctagtgttgctgcacgcagaatgcagaaagttcttcttggttgaacaggagtgcacagtgttgtgaaatacttaaaaaactgagcaaaatggttagacaagaaaatagagcttgaagttcactagaaatcttatcttcatcttaagtgttcatcaaagagtctgggatgatataaaacattttgtgtttcatctacccattcagcaagaatgagtccagtcccatgtttagattattttaacataatttgtgaatgatagtttcacatttggctgatggtttgcagttttcactcaagttttgcatgaatcacaaagcagaatggtaccttttgaagagcagttctgcaataagtcatgagtagtataacttttggacattgagatggagaaagtgagaaattatcaaagctataattgccagagttgcccttgggtttaggtagaacactgtataccatatatactatataccatatatactatatataccatatatattatatgccataaacaggattaaccctcccttttctaattgcctgtatgtctagattacagaactattcaaagaagctcacagatggttacatgggacaaacctttctgacaaactaactggtaaagtaaggcatataacatttacatgagatattaaaactttttcattattatcctttgttctatatgattgctattaaccttatgtaatctagcaatgactgttatagtgccttaatccagcaaggatataaaaatgtattcaagaagtaatgccagagcaacctataacctgacataccatgcagaacattgtaaaatattctttaacagaactaggtaaataactgtgtatctaatatccgatctcatggccctcttaacatttttttgtttaaatgtgcactcatcccttataagcacattacttttacacttaatggtaggccacaatcttcatcaatctgttcatcataagacagagtaagaatttttaacagaaaattctaaaagagatagaagctaggaaagcttctttatatcttgcattaaatgggtagggaaaaaatatgactctcacccatgtcatgtactggaccatctttctctactttttaaagaaaaactaatacaactagaaaaacatcacaacaagccaaat

SEQ ID NO: 305563 - DNA, 7845 bp, Homo sapiens
ctcggttcaggttccggggcgccgcagagctgccggcctctggaccgcgcgcggcgctctggggaatccggcgccacgcgccgtgcggtggccaggatggaggaggccggagcagcggtggtcacggccggggaggccgaactgaactggtcccgcctcagcgtgtccaccgagacgctggagtctgagctggaggcgcggggggaggagcggcgcggggcgcgggaggcgctgctgcggctgctgctgcctcacaaccgtctggtgtcgctgccacgggcgctgggcagcggcttcccgcacctccagctgctggacgtgagcggcaacgcgttgaccgcgctcgggccggagctgctcgctctgcgcggcctgcgcacgctgctggccaagaacaaccggctcggcgggcccagtgcgctgcccaagggcctggcccagtcgccgctctgccgcagcctccaggtgctcaacctcagcggcaactgtttccaggaggtgcctgcctcgctcttagagctgcgcgcgctgcagaccctgagcctgggcggcaaccaactgcagagcatcccggctgagatcgagaacttgcagagtttagagtgtttatatcttggaggaaatttcattaaagaaatcccaccagaattaggaaatctgccttctctgaattatttggtattatgtgacaacaaaatccaaagcatacctcctcaactttcacagttacattcacttcgttccctaagtcttcacaataacttgctgacatatctgcctcgagagatcctcaaccttattcatttggaagagttgagtttacgaggaaatccattggttgttcgttttgttagagatttaacctatgatcctccaactctcctggaattagctgcacggaccattaagattcgaaatatttcctacactccctatgatcttcctggaaatcttcttagatacttgggttcagccagcaattgcccaaacccaaagtgtggaggagtctactttgactgctgtgtcagacaaattaaatttgtggacttctgtgggaagtatcgcctcccactgatgcactacttgtgttcaccagaatgttcttccccttgcagttctgcctctcacagctccacttcccagagtgaatctgactcagaagatgaagctagtgttgctgcacgcagaatgcagaaagttcttcttggttgaacaggagtgcacagtgttgtgaaatacttaaaaaactgagcaaaatggttagacaagaaaatagagcttgaagttcactagaaatcttatcttcatcttaagtgttcatcaaagagtctgggatgatataaaacattttgtgtttcatctacccattcagcaagaatgagtccagtcccatgtttagattattttaacataatttgtgaatgatagtttcacatttggctgatggtttgcagttttcactcaagttttgcatgaatcacaaagcagaatggtaccttttgaagagcagttctgcaataagtcatgagtagtataacttttggacattgagatggagaaagtgagaaattatcaaagctataattgccagagttgcccttgggtttaggtagaacactgtataccatatatactatataccatatatactatatataccatatatattatatgccataaacaggattaaccctcccttttctaattgcctgtatgtctagattacagaactattcaaagaagctcacagatggttacatgggacaaacctttctgacaaactaactggtaaagtaaggcatataacatttacatgagatattaaaactttttcattattatcctttgttctatatgattgctattaaccttatgtaatctagcaatgactgttatagtgccttaatccagcaaggatataaaaatgtattcaagaagtaatgccagagcaacctataacctgacataccatgcagaacattgtaaaatattctttaacagaactaggtaaataactgtgtatctaatatccgatctcatggccctcttaacatttttttgtttaaatgtgcactcatcccttataagcacattacttttacacttaatggtaggccacaatcttcatcaatctgttcatcataagacagagtaagaatttttaacagaaaattctaaaagagatagaagctaggaaagcttctttatatcttgcattaaatgggtagggaaaaaatatgactctcacccatgtcatgtactggaccatctttctctactttttaaagaaaaactaatacaactagaaaaacatcacaacaagccaaataaaaatggagaaaaggagtcattgtccttatacctaatggaacagtttccagaactactttaactatggaagcatttttgaaaataaagtattaataaaatagaaaaaaattattaaatatattgtatccttaatgtatagcaggaaaatagtttcacaaattaattgctattagaaattaccaaatttttattaagtactttaatatgcaatacaaattgaataatagtacaactataagttgatataaagtaagtgcttactggtaatcattaaataactaataacatgacttgttggttaatgttaaacctacagtaagaaatgttatacagatcagataggcattagaacatcaggtgataccttttctgatttctggcattcatggcacaccatttcttaaaagcagattgttgtataataacatatacatgtattagggtttttttcatatatattttttattttagaagaaactagcataattcagggtttatgtgtttatttgtatattaattcatgaaacatgagagtttcatgaactgcagatgtgaaacgctgctatagaatgaatcccttcacctttaccttgttataatgtagtaagattttgttttccttttgactcagaaattttctatgtctatagaggtaatctaatatgttcctactgcctagaagagtaatacataggtgattatatcataaaatagaggtataaagtctttgcttacttctccatgtgggccacagcaagctgcagactgtacagttatgaaaggtaaagatgacttaggctgtgcctaagtgacaaatgtaaaatgttttgtaaataagtgacttacctaagatacataagatattttcatagaaaataatgtattcatagtaaaatactcaaattgataggaccaattttttctggcctaaatgcttatgcctacttcctaatcaattaccagcttgacttaagtaactgcttgagtagtcttctaagagttagtcttcgtaaaataaatggataggtatgtaaatatataatcttacataccctttccagcttcctagaaaggtctactgcttcatcttttacagatgtaaataggtccaaccagagacagtttctggcctttgcatataagaatatagatgtataccacagtattatttcaacaaaatgttatggttctatgtatagttgaaaactctatgatcagcatacaactgtcttttggtaatttttaatgaagtctacatttagccgtcggttttatctttcttaaatctttgacctaaacttttgtaagagcagctaataatttctaagattttccctgtttctttttcctacctttccttttctcataactgattggagaaattaatcagaagtcaaatacaagggacttcataatctagaaaccagataatcagctcccaagtcatgtagctaactatgcatttaaaataagtctgtctctttagttcttaagtcatatatttgtttgttaattacagtaaatgaactttaattggggtttttaaaagacagaattagcgaagtctaatttttataatgaaataagtttttgatattgctctacttggacgattttagtgaccaaaactatggataaaactgcctaagcataacattaatatatttagaatggcattcttcagtgctagtatttgaaattggaattagtacattgtgcattcttagtagtctttatccctagaatcaattctctcagcatcaccaaactgaattggtgaaatagtgctaagattctgggcaataggaagattagtgaatatgatacattgattccagggtgccagggattggctgacattaaggaccagctggctatggtcctcaggctacggtcctcagtattctagtatttgagtagtggaggtaaatccaaaggcgactggttatattttacttctaaatgtgtgctgaagtgtctcttgttcaaaaattcttgatatttagagcttcaagttaccacatttaaaagtaaagacttggcacggtggcacacacctataatcttagcactttgggaggccgaagtggatggatcatatgcagtcaggaatttgagaccagcctggccaacatggtgaaacctcatctttactaaaaatacaaaaattagccgggcgttgtgacgcacacccatagtcccagctaactccggaggctaagacaagagaatcacttgaacttgggagacagaggttgcagtaatctgagatcactccgctgcactccagcctgagtgagagtgagactgtgtctcaaacaaacaaacaaaaaacaaacaaaaaaatttgcattgtaaattgtacctcaaatttgagcagtttttgtgtttgtgtaaattaaagtaaaaagcagtccacaataatgttttgtaatactgcacaccagttctaccagattttgtaactatcagatttaaatgaaaaaagagaaggaagaggctgattgctggagtgttaaagaaatcttggccgggcgtggtggctcacgcttgtaatcccagcactttgggaggccgaggcgggtggatcacgaggtcaggagatcgagaccatcctggctaacacggtgaaaccccgtctctactaaaaatacaaaaaaaaattagccgggcgtgatggcgggcgcctgtagtcccagctactcgggaggctgaggcaagagaatggcgtgaacccgggaggcggagcttgcagtgagccgagattgcgccactgcactcccgcctgggccacagagcgagactccgtctcaaaaaaaaaaaaaaaaaaaaaaaaagaaatctttagaagccacagggctagaagagaagtcaccaaacacctagggacagtcctaggcctagaaagccctttaaagtaatagtgaattgttttaaaattaagttattgagtggcctactgactgccatccaaaaacctttatcaccaaatttgttcagtgtttgctattgggagattgtccatatccctccgtaattaagggccagcaagtaatacgatcttcttacagccaaccttgctcttcccaaagggagaaagtaatacatcattaacctggaatttgtgatataacaggtagccttggttaatgtttaccttttcactatgtaaaaaagaaaaaacacacagcaaatagtgcaaataaaatttggtcttttaaagcattttagcagtagctatgtaaaaaaagttaatggttattattcctaaattttcataagacccttggtagacaaaactatcggttatattatgtatatatgaggttagttaagctgcatttagttaggaacatttaatttttacctaaatgatccttttttcatccagaggtagagattttattgtcattatgaatgttactccccatttagtccaaaatagtgagcttttaagttgtgccaggtacttaacaatagtaaaagctattgtatagatttttattcaatgtgacctataatacatttctgattccttctgtattgaatgtcccagtttccatattaagtgctatgccctgtataacattaatgaatttaatagtgtacaattttgggccaggcatggtggctcacgccagtaatcctggcactttgggaggcagaggcaggcagatcacctgaggtcaggggttcgagatcagcctggccaacatggcaaaatcacatctctactaaaaatacaaaaattagccaggcgtggtggtgcatgcctgtagtcccagctactcaggaggctgaggcaggagaatcgcttgaacccaggaggcggaggttgcagtgagccgagatcatgccattgcactccagcctgggagacagagcaagactctatctcaaaaataaaaataaaaaaaaaattgcgtgcaattttgtattttcatagtcgtatctttttaaaggtatcatgatttcagttgtggtcaggaagtatgtgccttaaatcctctactctagacccaaagtttggagagctatattatttaataagttgtttgtgacagccttgttacctttttcatttgatttgagggagaaagactgtgatcctgacagattccttctcataaaatggcctaatgtgtatcagtctaggacttctggggagggaacctctaccatgcattctgtcccaggatgtcaaagtcataagaatcagggtcccctgaaataaaatcactgaaaagatatgttctgttatatattatttaaaaaatttatctggtgccaccaaagaatgacagcagtttctaaccaacttcatatttatagcatcttatgaagatattgtaaggcttagcatattttgccactggttttctttgtaatataggttgaaagtgagacatgtttgaatacttttgtatgtaaatatctcccattctttttctatctcttcttggtctatatttactaagaattgatatttaaaaaacagttcactaatgaactctacatattattgaacactcacagggcaatattgatttgggtgctactagacttttacctaacattagtctttctcaatagttgttgtaaaggatagtattcaatccagtaaatattaaagtgtattagtttaatgaaggttatttatatactgtcataccacaaacctatggtggaaagaacatctgcattcaccagaatgtacttgttcctttggctgtgaataaattggataagacttttttattgtaagttccagctgttggaagatacggggataagattgacattgctgttgcagtattgcaaaaacatgactaaattggttaattatgtctaccgcttatgtttaagagaatcctttcactaacttaaattgttaacattgttgtgatattgagaaagaatattaacctaaacagtcactttacaacaatcatgtaaagacgtgtgcctgcagttgaggttttttgcatttctgagcctgctttgtattcatgagaaacaaaaacataatgggagaaaagttttagataagcagcattgtaagtttttgtaaagtttgggatgtcaaagtattaacgaagggtactgaaaacatacttttacttgggtcaaattactttttatgatctgatttcttaattttctgtatttgaaatcttgcaaattaggaatatctacatctatagataaataagtaaaacttaatggtagaaataagtgtaattcagcaacatgattcaacaatttttatatttaggataagttattgtttattatattaatatcaaatttatatattgccttgtaatgctaaatgctcttaaaagaatatatgggctacttcaattctaccaccttcttccccctcccccaggacgtacaaaagatcttatattaaccaatcctctgtgaattttgccatatcaaacattgtgccttattttaataaaactgttttgttggaatccagttctatattaaagtctctataatgtt

SEQ ID NO: 305564 - DNA, 7983 bp, Homo sapiens
ctcggttcaggttccggggcgccgcagagctgccggcctctggaccgcgcgcggcgctctggggaatccggcgccacgcgccgtgcggtggccaggatggaggaggccggagcagcggtggtcacggccggggaggccgaactgaactggtcccgcctcagcgtgtccaccgagacgctggagtctgagctggaggcgcggggggaggagcggcgcggggcgcgggaggcgctgctgcggctgctgctgcctcacaaccgtctggtgtcgctgccacgggcgctgggcagcggcttcccgcacctccagctgctggacgtgagcggcaacgcgttgaccgcgctcgggccggagctgctcgctctgcgcggcctgcgcacgctgctggccaagaacaaccggctcggcgggcccagtgcgctgcccaagggcctggcccagtcgccgctctgccgcagcctccaggtgctcaacctcagcggcaactgtttccaggaggtgcctgcctcgctcttagagctgcgcgcgctgcagaccctgagcctgggcggcaaccaactgcagagcatcccggctgagatcgagaacttgcagagtttagagtgtttatatcttggaggaaatttcattaaagaaatcccaccagaattaggaaatctgccttctctgaattatttggtattatgtgacaacaaaatccaaagcatacctcctcaactttcacagttacattcacttcgttccctaagtcttcacaataacttgctgacatatctgcctcgagagatcctcaaccttattcatttggaagagttgagtttacgaggaaatccattggttgttcgttttgttagagatttaacctatgatcctccaactctcctggaattagctgcacggaccattaagattcgaaatatttcctacactccctatgatcttcctggaaatcttcttagatacttgggttcagccagcaattgcccaaacccaaagtgtggaggagtctactttgactgctgtgtcagacaaattaaatttgtggacttctgtgggaagtatcgcctcccactgatgcactacttgtgttcaccagaatgttcttccccttgcagttctgcctctcacagctccacttcccagagtgaatctgactcagaagatgaagctagtgttgctgcacgcagaatgcagaaagttcttcttggttgaacaggagtgcacagtgttgtgaaatacttaaaaaactgagcaaaatggttagacaagaaaatagagcttgaagttcactagaaatcttatcttcatcttaagtgttcatcaaagagtctgggatgatataaaacattttgtgtttcatctacccattcagcaagaatgagtccagtcccatgtttagattattttaacataatttgtgaatgatagtttcacatttggctgatggtttgcagttttcactcaagttttgcatgaatcacaaagcagaatggtaccttttgaagagcagttctgcaataagtcatgagtagtataacttttggacattgagatggagaaagtgagaaattatcaaagctataattgccagagttgcccttgggtttaggtagaacactgtataccatatatactatataccatatatactatatataccatatatattatatgccataaacaggattaaccctcccttttctaattgcctgtatgtctagattacagaactattcaaagaagctcacagatggttacatgggacaaacctttctgacaaactaactggtaaagtaaggcatataacatttacatgagatattaaaactttttcattattatcctttgttctatatgattgctattaaccttatgtaatctagcaatgactgttatagtgccttaatccagcaaggatataaaaatgtattcaagaagtaatgccagagcaacctataacctgacataccatgcagaacattgtaaaatattctttaacagaactaggtaaataactgtgtatctaatatccgatctcatggccctcttaacatttttttgtttaaatgtgcactcatcccttataagcacattacttttacacttaatggtaggccacaatcttcatcaatctgttcatcataagacagagtaagaatttttaacagaaaattctaaaagagatagaagctaggaaagcttctttatatcttgcattaaatgggtagggaaaaaatatgactctcacccatgtcatgtactggaccatctttctctactttttaaagaaaaactaatacaactagaaaaacatcacaacaagccaaataaaaatggagaaaaggagtcattgtccttatacctaatggaacagtttccagaactactttaactatggaagcatttttgaaaataaagtattaataaaatagaaaaaaattattaaatatattgtatccttaatgtatagcaggaaaatagtttcacaaattaattgctattagaaattaccaaatttttattaagtactttaatatgcaatacaaattgaataatagtacaactataagttgatataaagtaagtgcttactggtaatcattaaataactaataacatgacttgttggttaatgttaaacctacagtaagaaatgttatacagatcagataggcattagaacatcaggtgataccttttctgatttctggcattcatggcacaccatttcttaaaagcagattgttgtataataacatatacatgtattagggtttttttcatatatattttttattttagaagaaactagcataattcagggtttatgtgtttatttgtatattaattcatgaaacatgagagtttcatgaactgcagatgtgaaacgctgctatagaatgaatcccttcacctttaccttgttataatgtagtaagattttgttttccttttgactcagaaattttctatgtctatagaggtaatctaatatgttcctactgcctagaagagtaatacataggtgattatatcataaaatagaggtataaagtctttgcttacttctccatgtgggccacagcaagctgcagactgtacagttatgaaaggtaaagatgacttaggctgtgcctaagtgacaaatgtaaaatgttttgtaaataagtgacttacctaagatacataagatattttcatagaaaataatgtattcatagtaaaatactcaaattgataggaccaattttttctggcctaaatgcttatgcctacttcctaatcaattaccagcttgacttaagtaactgcttgagtagtcttctaagagttagtcttcgtaaaataaatggataggtatgtaaatatataatcttacataccctttccagcttcctagaaaggtctactgcttcatcttttacagatgtaaataggtccaaccagagacagtttctggcctttgcatataagaatatagatgtataccacagtattatttcaacaaaatgttatggttctatgtatagttgaaaactctatgatcagcatacaactgtcttttggtaatttttaatgaagtctacatttagccgtcggttttatctttcttaaatctttgacctaaacttttgtaagagcagctaataatttctaagattttccctgtttctttttcctacctttccttttctcataactgattggagaaattaatcagaagtcaaatacaagggacttcataatctagaaaccagataatcagctcccaagtcatgtagctaactatgcatttaaaataagtctgtctctttagttcttaagtcatatatttgtttgttaattacagtaaatgaactttaattggggtttttaaaagacagaattagcgaagtctaatttttataatgaaataagtttttgatattgctctacttggacgattttagtgaccaaaactatggataaaactgcctaagcataacattaatatatttagaatggcattcttcagtgctagtatttgaaattggaattagtacattgtgcattcttagtagtctttatccctagaatcaattctctcagcatcaccaaactgaattggtgaaatagtgctaagattctgggcaataggaagattagtgaatatgatacattgattccagggtgccagggattggctgacattaaggaccagctggctatggtcctcaggctacggtcctcagtattctagtatttgagtagtggaggtaaatccaaaggcgactggttatattttacttctaaatgtgtgctgaagtgtctcttgttcaaaaattcttgatatttagagcttcaagttaccacatttaaaagtaaagacttggcacggtggcacacacctataatcttagcactttgggaggccgaagtggatggatcatatgcagtcaggaatttgagaccagcctggccaacatggtgaaacctcatctttactaaaaatacaaaaattagccgggcgttgtgacgcacacccatagtcccagctaactccggaggctaagacaagagaatcacttgaacttgggagacagaggttgcagtaatctgagatcactccgctgcactccagcctgagtgagagtgagactgtgtctcaaacaaacaaacaaaaaacaaacaaaaaaatttgcattgtaaattgtacctcaaatttgagcagtttttgtgtttgtgtaaattaaagtaaaaagcagtccacaataatgttttgtaatactgcacaccagttctaccagattttgtaactatcagatttaaatgaaaaaagagaaggaagaggctgattgctggagtgttaaagaaatcttggccgggcgtggtggctcacgcttgtaatcccagcactttgggaggccgaggcgggtggatcacgaggtcaggagatcgagaccatcctggctaacacggtgaaaccccgtctctactaaaaatacaaaaaaaaattagccgggcgtgatggcgggcgcctgtagtcccagctactcgggaggctgaggcaagagaatggcgtgaacccgggaggcggagcttgcagtgagccgagattgcgccactgcactcccgcctgggccacagagcgagactccgtctcaaaaaaaaaaaaaaaaaaaaaaaaagaaatctttagaagccacagggctagaagagaagtcaccaaacacctagggacagtcctaggcctagaaagccctttaaagtaatagtgaattgttttaaaattaagttattgagtggcctactgactgccatccaaaaacctttatcaccaaatttgttcagtgtttgctattgggagattgtccatatccctccgtaattaagggccagcaagtaatacgatcttcttacagccaaccttgctcttcccaaagggagaaagtaatacatcattaacctggaatttgtgatataacaggtagccttggttaatgtttaccttttcactatgtaaaaaagaaaaaacacacagcaaatagtgcaaataaaatttggtcttttaaagcattttagcagtagctatgtaaaaaaagttaatggttattattcctaaattttcataagacccttggtagacaaaactatcggttatattatgtatatatgaggttagttaagctgcatttagttaggaacatttaatttttacctaaatgatccttttttcatccagaggtagagattttattgtcattatgaatgttactccccatttagtccaaaatagtgagcttttaagttgtgccaggtacttaacaatagtaaaagctattgtatagatttttattcaatgtgacctataatacatttctgattccttctgtattgaatgtcccagtttccatattaagtgctatgccctgtataacattaatgaatttaatagtgtacaattttgggccaggcatggtggctcacgccagtaatcctggcactttgggaggcagaggcaggcagatcacctgaggtcaggggttcgagatcagcctggccaacatggcaaaatcacatctctactaaaaatacaaaaattagccaggcgtggtggtgcatgcctgtagtcccagctactcaggaggctgaggcaggagaatcgcttgaacccaggaggcggaggttgcagtgagccgagatcatgccattgcactccagcctgggagacagagcaagactctatctcaaaaataaaaataaaaaaaaaattgcgtgcaattttgtattttcatagtcgtatctttttaaaggtatcatgatttcagttgtggtcaggaagtatgtgccttaaatcctctactctagacccaaagtttggagagctatattatttaataagttgtttgtgacagccttgttacctttttcatttgatttgagggagaaagactgtgatcctgacagattccttctcataaaatggcctaatgtgtatcagtctaggacttctggggagggaacctctaccatgcattctgtcccaggatgtcaaagtcataagaatcagggtcccctgaaataaaatcactgaaaagatatgttctgttatatattatttaaaaaatttatctggtgccaccaaagaatgacagcagtttctaaccaacttcatatttatagcatcttatgaagatattgtaaggcttagcatattttgccactggttttctttgtaatataggttgaaagtgagacatgtttgaatacttttgtatgtaaatatctcccattctttttctatctcttcttggtctatatttactaagaattgatatttaaaaaacagttcactaatgaactctacatattattgaacactcacagggcaatattgatttgggtgctactagacttttacctaacattagtctttctcaatagttgttgtaaaggatagtattcaatccagtaaatattaaagtgtattagtttaatgaaggttatttatatactgtcataccacaaacctatggtggaaagaacatctgcattcaccagaatgtacttgttcctttggctgtgaataaattggataagacttttttattgtaagttccagctgttggaagatacggggataagattgacattgctgttgcagtattgcaaaaacatgactaaattggttaattatgtctaccgcttatgtttaagagaatcctttcactaacttaaattgttaacattgttgtgatattgagaaagaatattaacctaaacagtcactttacaacaatcatgtaaagacgtgtgcctgcagttgaggttttttgcatttctgagcctgctttgtattcatgagaaacaaaaacataatgggagaaaagttttagataagcagcattgtaagtttttgtaaagtttgggatgtcaaagtattaacgaagggtactgaaaacatacttttacttgggtcaaattactttttatgatctgatttcttaattttctgtatttgaaatcttgcaaattaggaatatctacatctatagataaataagtaaaacttaatggtagaaataagtgtaattcagcaacatgattcaacaatttttatatttaggataagttattgtttattatattaatatcaaatttatatattgccttgtaatgctaaatgctcttaaaagaatatatgggctacttcaattctaccaccttcttccccctcccccaggacgtacaaaagatcttatattaaccaatcctctgtgaattttgccatatcaaacattgtgccttattttaataaaactgttttgttggaatccagttctatattaaagtctctataatgttgatatttgcctgattacttgttacatcattgaatacatacattaaatatgtactaacattgactctgttctagatgcaatggataaaagataaattggaaaaaaaaaagtcgacgcggccgcgaatttagtagtagta

SEQ ID NO: 305565 - DNA, 8162 bp, Homo sapiens
ctcggttcaggttccggggcgccgcagagctgccggcctctggaccgcgcgcggcgctctggggaatccggcgccacgcgccgtgcggtggccaggatggaggaggccggagcagcggtggtcacggccggggaggccgaactgaactggtcccgcctcagcgtgtccaccgagacgctggagtctgagctggaggcgcggggggaggagcggcgcggggcgcgggaggcgctgctgcggctgctgctgcctcacaaccgtctggtgtcgctgccacgggcgctgggcagcggcttcccgcacctccagctgctggacgtgagcggcaacgcgttgaccgcgctcgggccggagctgctcgctctgcgcggcctgcgcacgctgctggccaagaacaaccggctcggcgggcccagtgcgctgcccaagggcctggcccagtcgccgctctgccgcagcctccaggtgctcaacctcagcggcaactgtttccaggaggtgcctgcctcgctcttagagctgcgcgcgctgcagaccctgagcctgggcggcaaccaactgcagagcatcccggctgagatcgagaacttgcagagtttagagtgtttatatcttggaggaaatttcattaaagaaatcccaccagaattaggaaatctgccttctctgaattatttggtattatgtgacaacaaaatccaaagcatacctcctcaactttcacagttacattcacttcgttccctaagtcttcacaataacttgctgacatatctgcctcgagagatcctcaaccttattcatttggaagagttgagtttacgaggaaatccattggttgttcgttttgttagagatttaacctatgatcctccaactctcctggaattagctgcacggaccattaagattcgaaatatttcctacactccctatgatcttcctggaaatcttcttagatacttgggttcagccagcaattgcccaaacccaaagtgtggaggagtctactttgactgctgtgtcagacaaattaaatttgtggacttctgtgggaagtatcgcctcccactgatgcactacttgtgttcaccagaatgttcttccccttgcagttctgcctctcacagctccacttcccagagtgaatctgactcagaagatgaagctagtgttgctgcacgcagaatgcagaaagttcttcttggttgaacaggagtgcacagtgttgtgaaatacttaaaaaactgagcaaaatggttagacaagaaaatagagcttgaagttcactagaaatcttatcttcatcttaagtgttcatcaaagagtctgggatgatataaaacattttgtgtttcatctacccattcagcaagaatgagtccagtcccatgtttagattattttaacataatttgtgaatgatagtttcacatttggctgatggtttgcagttttcactcaagttttgcatgaatcacaaagcagaatggtaccttttgaagagcagttctgcaataagtcatgagtagtataacttttggacattgagatggagaaagtgagaaattatcaaagctataattgccagagttgcccttgggtttaggtagaacactgtataccatatatactatataccatatatactatatataccatatatattatatgccataaacaggattaaccctcccttttctaattgcctgtatgtctagattacagaactattcaaagaagctcacagatggttacatgggacaaacctttctgacaaactaactggtaaagtaaggcatataacatttacatgagatattaaaactttttcattattatcctttgttctatatgattgctattaaccttatgtaatctagcaatgactgttatagtgccttaatccagcaaggatataaaaatgtattcaagaagtaatgccagagcaacctataacctgacataccatgcagaacattgtaaaatattctttaacagaactaggtaaataactgtgtatctaatatccgatctcatggccctcttaacatttttttgtttaaatgtgcactcatcccttataagcacattacttttacacttaatggtaggccacaatcttcatcaatctgttcatcataagacagagtaagaatttttaacagaaaattctaaaagagatagaagctaggaaagcttctttatatcttgcattaaatgggtagggaaaaaatatgactctcacccatgtcatgtactggaccatctttctctactttttaaagaaaaactaatacaactagaaaaacatcacaacaagccaaataaaaatggagaaaaggagtcattgtccttatacctaatggaacagtttccagaactactttaactatggaagcatttttgaaaataaagtattaataaaatagaaaaaaattattaaatatattgtatccttaatgtatagcaggaaaatagtttcacaaattaattgctattagaaattaccaaatttttattaagtactttaatatgcaatacaaattgaataatagtacaactataagttgatataaagtaagtgcttactggtaatcattaaataactaataacatgacttgttggttaatgttaaacctacagtaagaaatgttatacagatcagataggcattagaacatcaggtgataccttttctgatttctggcattcatggcacaccatttcttaaaagcagattgttgtataataacatatacatgtattagggtttttttcatatatattttttattttagaagaaactagcataattcagggtttatgtgtttatttgtatattaattcatgaaacatgagagtttcatgaactgcagatgtgaaacgctgctatagaatgaatcccttcacctttaccttgttataatgtagtaagattttgttttccttttgactcagaaattttctatgtctatagaggtaatctaatatgttcctactgcctagaagagtaatacataggtgattatatcataaaatagaggtataaagtctttgcttacttctccatgtgggccacagcaagctgcagactgtacagttatgaaaggtaaagatgacttaggctgtgcctaagtgacaaatgtaaaatgttttgtaaataagtgacttacctaagatacataagatattttcatagaaaataatgtattcatagtaaaatactcaaattgataggaccaattttttctggcctaaatgcttatgcctacttcctaatcaattaccagcttgacttaagtaactgcttgagtagtcttctaagagttagtcttcgtaaaataaatggataggtatgtaaatatataatcttacataccctttccagcttcctagaaaggtctactgcttcatcttttacagatgtaaataggtccaaccagagacagtttctggcctttgcatataagaatatagatgtataccacagtattatttcaacaaaatgttatggttctatgtatagttgaaaactctatgatcagcatacaactgtcttttggtaatttttaatgaagtctacatttagccgtcggttttatctttcttaaatctttgacctaaacttttgtaagagcagctaataatttctaagattttccctgtttctttttcctacctttccttttctcataactgattggagaaattaatcagaagtcaaatacaagggacttcataatctagaaaccagataatcagctcccaagtcatgtagctaactatgcatttaaaataagtctgtctctttagttcttaagtcatatatttgtttgttaattacagtaaatgaactttaattggggtttttaaaagacagaattagcgaagtctaatttttataatgaaataagtttttgatattgctctacttggacgattttagtgaccaaaactatggataaaactgcctaagcataacattaatatatttagaatggcattcttcagtgctagtatttgaaattggaattagtacattgtgcattcttagtagtctttatccctagaatcaattctctcagcatcaccaaactgaattggtgaaatagtgctaagattctgggcaataggaagattagtgaatatgatacattgattccagggtgccagggattggctgacattaaggaccagctggctatggtcctcaggctacggtcctcagtattctagtatttgagtagtggaggtaaatccaaaggcgactggttatattttacttctaaatgtgtgctgaagtgtctcttgttcaaaaattcttgatatttagagcttcaagttaccacatttaaaagtaaagacttggcacggtggcacacacctataatcttagcactttgggaggccgaagtggatggatcatatgcagtcaggaatttgagaccagcctggccaacatggtgaaacctcatctttactaaaaatacaaaaattagccgggcgttgtgacgcacacccatagtcccagctaactccggaggctaagacaagagaatcacttgaacttgggagacagaggttgcagtaatctgagatcactccgctgcactccagcctgagtgagagtgagactgtgtctcaaacaaacaaacaaaaaacaaacaaaaaaatttgcattgtaaattgtacctcaaatttgagcagtttttgtgtttgtgtaaattaaagtaaaaagcagtccacaataatgttttgtaatactgcacaccagttctaccagattttgtaactatcagatttaaatgaaaaaagagaaggaagaggctgattgctggagtgttaaagaaatcttggccgggcgtggtggctcacgcttgtaatcccagcactttgggaggccgaggcgggtggatcacgaggtcaggagatcgagaccatcctggctaacacggtgaaaccccgtctctactaaaaatacaaaaaaaaattagccgggcgtgatggcgggcgcctgtagtcccagctactcgggaggctgaggcaagagaatggcgtgaacccgggaggcggagcttgcagtgagccgagattgcgccactgcactcccgcctgggccacagagcgagactccgtctcaaaaaaaaaaaaaaaaaaaaaaaaagaaatctttagaagccacagggctagaagagaagtcaccaaacacctagggacagtcctaggcctagaaagccctttaaagtaatagtgaattgttttaaaattaagttattgagtggcctactgactgccatccaaaaacctttatcaccaaatttgttcagtgtttgctattgggagattgtccatatccctccgtaattaagggccagcaagtaatacgatcttcttacagccaaccttgctcttcccaaagggagaaagtaatacatcattaacctggaatttgtgatataacaggtagccttggttaatgtttaccttttcactatgtaaaaaagaaaaaacacacagcaaatagtgcaaataaaatttggtcttttaaagcattttagcagtagctatgtaaaaaaagttaatggttattattcctaaattttcataagacccttggtagacaaaactatcggttatattatgtatatatgaggttagttaagctgcatttagttaggaacatttaatttttacctaaatgatccttttttcatccagaggtagagattttattgtcattatgaatgttactccccatttagtccaaaatagtgagcttttaagttgtgccaggtacttaacaatagtaaaagctattgtatagatttttattcaatgtgacctataatacatttctgattccttctgtattgaatgtcccagtttccatattaagtgctatgccctgtataacattaatgaatttaatagtgtacaattttgggccaggcatggtggctcacgccagtaatcctggcactttgggaggcagaggcaggcagatcacctgaggtcaggggttcgagatcagcctggccaacatggcaaaatcacatctctactaaaaatacaaaaattagccaggcgtggtggtgcatgcctgtagtcccagctactcaggaggctgaggcaggagaatcgcttgaacccaggaggcggaggttgcagtgagccgagatcatgccattgcactccagcctgggagacagagcaagactctatctcaaaaataaaaataaaaaaaaaattgcgtgcaattttgtattttcatagtcgtatctttttaaaggtatcatgatttcagttgtggtcaggaagtatgtgccttaaatcctctactctagacccaaagtttggagagctatattatttaataagttgtttgtgacagccttgttacctttttcatttgatttgagggagaaagactgtgatcctgacagattccttctcataaaatggcctaatgtgtatcagtctaggacttctggggagggaacctctaccatgcattctgtcccaggatgtcaaagtcataagaatcagggtcccctgaaataaaatcactgaaaagatatgttctgttatatattatttaaaaaatttatctggtgccaccaaagaatgacagcagtttctaaccaacttcatatttatagcatcttatgaagatattgtaaggcttagcatattttgccactggttttctttgtaatataggttgaaagtgagacatgtttgaatacttttgtatgtaaatatctcccattctttttctatctcttcttggtctatatttactaagaattgatatttaaaaaacagttcactaatgaactctacatattattgaacactcacagggcaatattgatttgggtgctactagacttttacctaacattagtctttctcaatagttgttgtaaaggatagtattcaatccagtaaatattaaagtgtattagtttaatgaaggttatttatatactgtcataccacaaacctatggtggaaagaacatctgcattcaccagaatgtacttgttcctttggctgtgaataaattggataagacttttttattgtaagttccagctgttggaagatacggggataagattgacattgctgttgcagtattgcaaaaacatgactaaattggttaattatgtctaccgcttatgtttaagagaatcctttcactaacttaaattgttaacattgttgtgatattgagaaagaatattaacctaaacagtcactttacaacaatcatgtaaagacgtgtgcctgcagttgaggttttttgcatttctgagcctgctttgtattcatgagaaacaaaaacataatgggagaaaagttttagataagcagcattgtaagtttttgtaaagtttgggatgtcaaagtattaacgaagggtactgaaaacatacttttacttgggtcaaattactttttatgatctgatttcttaattttctgtatttgaaatcttgcaaattaggaatatctacatctatagataaataagtaaaacttaatggtagaaataagtgtaattcagcaacatgattcaacaatttttatatttaggataagttattgtttattatattaatatcaaatttatatattgccttgtaatgctaaatgctcttaaaagaatatatgggctacttcaattctaccaccttcttccccctcccccaggacgtacaaaagatcttatattaaccaatcctctgtgaattttgccatatcaaacattgtgccttattttaataaaactgttttgttggaaaaaacacaaaaaaacaaaaaaaaaaagggggggggggaaaaaaatccccggggggggccattatggcccccgtttctgtgcaaagggggccccaaagagggggggaaaaaaagaagaagcagggggcggttaaacactgcggcggggaaagcgctcgggttctgggaaagaactctctgggcgggccactggggacccccccagaattagatcggaaataaactctgtttagttcaccgcgttattcgtgcggaatcgtcgtttttactagacatactatgataaaacgccacgcttctgctatatattaaaaaaacaaccacgaaaatatagaacacactatataaa

SEQ ID NO: 305566 - DNA, 7791 bp, Homo sapiens
ctcggttcaggttccggggcgccgcagagctgccggcctctggaccgcgcgcggcgctctggggaatccggcgccacgcgccgtgcggtggccaggatggaggaggccggagcagcggtggtcacggccggggaggccgaactgaactggtcccgcctcagcgtgtccaccgagacgctggagtctgagctggaggcgcggggggaggagcggcgcggggcgcgggaggcgctgctgcggctgctgctgcctcacaaccgtctggtgtcgctgccacgggcgctgggcagcggcttcccgcacctccagctgctggacgtgagcggcaacgcgttgaccgcgctcgggccggagctgctcgctctgcgcggcctgcgcacgctgctggccaagaacaaccggctcggcgggcccagtgcgctgcccaagggcctggcccagtcgccgctctgccgcagcctccaggtgctcaacctcagcggcaactgtttccaggaggtgcctgcctcgctcttagagctgcgcgcgctgcagaccctgagcctgggcggcaaccaactgcagagcatcccggctgagatcgagaacttgcagagtttagagtgtttatatcttggaggaaatttcattaaagaaatcccaccagaattaggaaatctgccttctctgaattatttggtattatgtgacaacaaaatccaaagcatacctcctcaactttcacagttacattcacttcgttccctaagtcttcacaataacttgctgacatatctgcctcgagagatcctcaaccttattcatttggaagagttgagtttacgaggaaatccattggttgttcgttttgttagagatttaacctatgatcctccaactctcctggaattagctgcacggaccattaagattcgaaatatttcctacactccctatgatcttcctggaaatcttcttagatacttgggttcagccagcaattgcccaaacccaaagtgtggaggagtctactttgactgctgtgtcagacaaattaaatttgtggacttctgtgggaagtatcgcctcccactgatgcactacttgtgttcaccagaatgttcttccccttgcagttctgcctctcacagctccacttcccagagtgaatctgactcagaagatgaagctagtgttgctgcacgcagaatgcagaaagttcttcttggttgaacaggagtgcacagtgttgtgaaatacttaaaaaactgagcaaaatggttagacaagaaaatagagcttgaagttcactagaaatcttatcttcatcttaagtgttcatcaaagagtctgggatgatataaaacattttgtgtttcatctacccattcagcaagaatgagtccagtcccatgtttagattattttaacataatttgtgaatgatagtttcacatttggctgatggtttgcagttttcactcaagttttgcatgaatcacaaagcagaatggtaccttttgaagagcagttctgcaataagtcatgagtagtataacttttggacattgagatggagaaagtgagaaattatcaaagctataattgccagagttgcccttgggtttaggtagaacactgtataccatatatactatataccatatatactatatataccatatatattatatgccataaacaggattaaccctcccttttctaattgcctgtatgtctagattacagaactattcaaagaagctcacagatggttacatgggacaaacctttctgacaaactaactggtaaagtaaggcatataacatttacatgagatattaaaactttttcattattatcctttgttctatatgattgctattaaccttatgtaatctagcaatgactgttatagtgccttaatccagcaaggatataaaaatgtattcaagaagtaatgccagagcaacctataacctgacataccatgcagaacattgtaaaatattctttaacagaactaggtaaataactgtgtatctaatatccgatctcatggccctcttaacatttttttgtttaaatgtgcactcatcccttataagcacattacttttacacttaatggtaggccacaatcttcatcaatctgttcatcataagacagagtaagaatttttaacagaaaattctaaaagagatagaagctaggaaagcttctttatatcttgcattaaatgggtagggaaaaaatatgactctcacccatgtcatgtactggaccatctttctctactttttaaagaaaaactaatacaactagaaaaacatcacaacaagccaaataaaaatggagaaaaggagtcattgtccttatacctaatggaacagtttccagaactactttaactatggaagcatttttgaaaataaagtattaataaaatagaaaaaaattattaaatatattgtatccttaatgtatagcaggaaaatagtttcacaaattaattgctattagaaattaccaaatttttattaagtactttaatatgcaatacaaattgaataatagtacaactataagttgatataaagtaagtgcttactggtaatcattaaataactaataacatgacttgttggttaatgttaaacctacagtaagaaatgttatacagatcagataggcattagaacatcaggtgataccttttctgatttctggcattcatggcacaccatttcttaaaagcagattgttgtataataacatatacatgtattagggtttttttcatatatattttttattttagaagaaactagcataattcagggtttatgtgtttatttgtatattaattcatgaaacatgagagtttcatgaactgcagatgtgaaacgctgctatagaatgaatcccttcacctttaccttgttataatgtagtaagattttgttttccttttgactcagaaattttctatgtctatagaggtaatctaatatgttcctactgcctagaagagtaatacataggtgattatatcataaaatagaggtataaagtctttgcttacttctccatgtgggccacagcaagctgcagactgtacagttatgaaaggtaaagatgacttaggctgtgcctaagtgacaaatgtaaaatgttttgtaaataagtgacttacctaagatacataagatattttcatagaaaataatgtattcatagtaaaatactcaaattgataggaccaattttttctggcctaaatgcttatgcctacttcctaatcaattaccagcttgacttaagtaactgcttgagtagtcttctaagagttagtcttcgtaaaataaatggataggtatgtaaatatataatcttacataccctttccagcttcctagaaaggtctactgcttcatcttttacagatgtaaataggtccaaccagagacagtttctggcctttgcatataagaatatagatgtataccacagtattatttcaacaaaatgttatggttctatgtatagttgaaaactctatgatcagcatacaactgtcttttggtaatttttaatgaagtctacatttagccgtcggttttatctttcttaaatctttgacctaaacttttgtaagagcagctaataatttctaagattttccctgtttctttttcctacctttccttttctcataactgattggagaaattaatcagaagtcaaatacaagggacttcataatctagaaaccagataatcagctcccaagtcatgtagctaactatgcatttaaaataagtctgtctctttagttcttaagtcatatatttgtttgttaattacagtaaatgaactttaattggggtttttaaaagacagaattagcgaagtctaatttttataatgaaataagtttttgatattgctctacttggacgattttagtgaccaaaactatggataaaactgcctaagcataacattaatatatttagaatggcattcttcagtgctagtatttgaaattggaattagtacattgtgcattcttagtagtctttatccctagaatcaattctctcagcatcaccaaactgaattggtgaaatagtgctaagattctgggcaataggaagattagtgaatatgatacattgattccagggtgccagggattggctgacattaaggaccagctggctatggtcctcaggctacggtcctcagtattctagtatttgagtagtggaggtaaatccaaaggcgactggttatattttacttctaaatgtgtgctgaagtgtctcttgttcaaaaattcttgatatttagagcttcaagttaccacatttaaaagtaaagacttggcacggtggcacacacctataatcttagcactttgggaggccgaagtggatggatcatatgcagtcaggaatttgagaccagcctggccaacatggtgaaacctcatctttactaaaaatacaaaaattagccgggcgttgtgacgcacacccatagtcccagctaactccggaggctaagacaagagaatcacttgaacttgggagacagaggttgcagtaatctgagatcactccgctgcactccagcctgagtgagagtgagactgtgtctcaaacaaacaaacaaaaaacaaacaaaaaaatttgcattgtaaattgtacctcaaatttgagcagtttttgtgtttgtgtaaattaaagtaaaaagcagtccacaataatgttttgtaatactgcacaccagttctaccagattttgtaactatcagatttaaatgaaaaaagagaaggaagaggctgattgctggagtgttaaagaaatcttggccgggcgtggtggctcacgcttgtaatcccagcactttgggaggccgaggcgggtggatcacgaggtcaggagatcgagaccatcctggctaacacggtgaaaccccgtctctactaaaaatacaaaaaaaaattagccgggcgtgatggcgggcgcctgtagtcccagctactcgggaggctgaggcaagagaatggcgtgaacccgggaggcggagcttgcagtgagccgagattgcgccactgcactcccgcctgggccacagagcgagactccgtctcaaaaaaaaaaaaaaaaaaaaaaaaagaaatctttagaagccacagggctagaagagaagtcaccaaacacctagggacagtcctaggcctagaaagccctttaaagtaatagtgaattgttttaaaattaagttattgagtggcctactgactgccatccaaaaacctttatcaccaaatttgttcagtgtttgctattgggagattgtccatatccctccgtaattaagggccagcaagtaatacgatcttcttacagccaaccttgctcttcccaaagggagaaagtaatacatcattaacctggaatttgtgatataacaggtagccttggttaatgtttaccttttcactatgtaaaaaagaaaaaacacacagcaaatagtgcaaataaaatttggtcttttaaagcattttagcagtagctatgtaaaaaaagttaatggttattattcctaaattttcataagacccttggtagacaaaactatcggttatattatgtatatatgaggttagttaagctgcatttagttaggaacatttaatttttacctaaatgatccttttttcatccagaggtagagattttattgtcattatgaatgttactccccatttagtccaaaatagtgagcttttaagttgtgccaggtacttaacaatagtaaaagctattgtatagatttttattcaatgtgacctataatacatttctgattccttctgtattgaatgtcccagtttccatattaagtgctatgccctgtataacattaatgaatttaatagtgtacaattttgggccaggcatggtggctcacgccagtaatcctggcactttgggaggcagaggcaggcagatcacctgaggtcaggggttcgagatcagcctggccaacatggcaaaatcacatctctactaaaaatacaaaaattagccaggcgtggtggtgcatgcctgtagtcccagctactcaggaggctgaggcaggagaatcgcttgaacccaggaggcggaggttgcagtgagccgagatcatgccattgcactccagcctgggagacagagcaagactctatctcaaaaataaaaataaaaaaaaaattgcgtgcaattttgtattttcatagtcgtatctttttaaaggtatcatgatttcagttgtggtcaggaagtatgtgccttaaatcctctactctagacccaaagtttggagagctatattatttaataagttgtttgtgacagccttgttacctttttcatttgatttgagggagaaagactgtgatcctgacagattccttctcataaaatggcctaatgtgtatcagtctaggacttctggggagggaacctctaccatgcattctgtcccaggatgtcaaagtcataagaatcagggtcccctgaaataaaatcactgaaaagatatgttctgttatatattatttaaaaaatttatctggtgccaccaaagaatgacagcagtttctaaccaacttcatatttatagcatcttatgaagatattgtaaggcttagcatattttgccactggttttctttgtaatataggttgaaagtgagacatgtttgaatacttttgtatgtaaatatctcccattctttttctatctcttcttggtctatatttactaagaattgatatttaaaaaacagttcactaatgaactctacatattattgaacactcacagggcaatattgatttgggtgctactagacttttacctaacattagtctttctcaatagttgttgtaaaggatagtattcaatccagtaaatattaaagtgtattagtttaatgaaggttatttatatactgtcataccacaaacctatggtggaaagaacatctgcattcaccagaatgtacttgttcctttggctgtgaataaattggataagacttttttattgtaagttccagctgttggaagatacggggataagattgacattgctgttgcagtattgcattcactaacttaaattgttaacattgttgtgatattgagaaagaatattaacctaaacagtcactttacaacaatcatgtaaagacgtgtgcctgcagttgaggttttttgcatttctgagcctgctttgtattcatgagaaacaaaaacataatgggagaaaagttttagataagcagcattgtaagtttttgtaaagtttgggatgtcaaagtattaacgaagggtactgaaaacatacttttacttgggtcaaattactttttatgatctgatttcttaattttctgtatttgaaatcttgcaaattaggaatatctacatctatagataaataagtaaaacttaatggtagaaataagtgtaattcagcaacatgattcaacaatttttatatttaggataagttattgtttattatattaatatcaaatttatatattgccttgtaatgctaaatgctcttaaaagaatatatgggctacttcaattctaccaccttcttccccctcccccaggacgtacaaaagatcttatattaaccaatcctctgtgaattttgccatatcaaacattgtgccttattttaataaaactgttttgttggaatccagttctatattaaagtctctataatgtt

SEQ ID NO: 305567 - DNA, 7791 bp, Homo sapiens
ctcggttcaggttccggggcgccgcagagctgccggcctctggaccgcgcgcggcgctctggggaatccggcgccacgcgccgtgcggtggccaggatggaggaggccggagcagcggtggtcacggccggggaggccgaactgaactggtcccgcctcagcgtgtccaccgagacgctggagtctgagctggaggcgcggggggaggagcggcgcggggcgcgggaggcgctgctgcggctgctgctgcctcacaaccgtctggtgtcgctgccacgggcgctgggcagcggcttcccgcacctccagctgctggacgtgagcggcaacgcgttgaccgcgctcgggccggagctgctcgctctgcgcggcctgcgcacgctgctggccaagaacaaccggctcggcgggcccagtgcgctgcccaagggcctggcccagtcgccgctctgccgcagcctccaggtgctcaacctcagcggcaactgtttccaggaggtgcctgcctcgctcttagagctgcgcgcgctgcagaccctgagcctgggcggcaaccaactgcagagcatcccggctgagatcgagaacttgcagagtttagagtgtttatatcttggaggaaatttcattaaagaaatcccaccagaattaggaaatctgccttctctgaattatttggtattatgtgacaacaaaatccaaagcatacctcctcaactttcacagttacattcacttcgttccctaagtcttcacaataacttgctgacatatctgcctcgagagatcctcaaccttattcatttggaagagttgagtttacgaggaaatccattggttgttcgttttgttagagatttaacctatgatcctccaactctcctggaattagctgcacggaccattaagattcgaaatatttcctacactccctatgatcttcctggaaatcttcttagatacttgggttcagccagcaattgcccaaacccaaagtgtggaggagtctactttgactgctgtgtcagacaaattaaatttgtggacttctgtgggaagtatcgcctcccactgatgcactacttgtgttcaccagaatgttcttccccttgcagttctgcctctcacagctccacttcccagagtgaatctgactcagaagatgaagctagtgttgctgcacgcagaatgcagaaagttcttcttggttgaacaggagtgcacagtgttgtgaaatacttaaaaaactgagcaaaatggttagacaagaaaatagagcttgaagttcactagaaatcttatcttcatcttaagtgttcatcaaagagtctgggatgatataaaacattttgtgtttcatctacccattcagcaagaatgagtccagtcccatgtttagattattttaacataatttgtgaatgatagtttcacatttggctgatggtttgcagttttcactcaagttttgcatgaatcacaaagcagaatggtaccttttgaagagcagttctgcaataagtcatgagtagtataacttttggacattgagatggagaaagtgagaaattatcaaagctataattgccagagttgcccttgggtttaggtagaacactgtataccatatatactatataccatatatactatatataccatatatattatatgccataaacaggattaaccctcccttttctaattgcctgtatgtctagattacagaactattcaaagaagctcacagatggttacatgggacaaacctttctgacaaactaactggtaaagtaaggcatataacatttacatgagatattaaaactttttcattattatcctttgttctatatgattgctattaaccttatgtaatctagcaatgactgttatagtgccttaatccagcaaggatataaaaatgtattcaagaagtaatgccagagcaacctataacctgacataccatgcagaacattgtaaaatattctttaacagaactaggtaaataactgtgtatctaatatccgatctcatggccctcttaacatttttttgtttaaatgtgcactcatcccttataagcacattacttttacacttaatggtaggccacaatcttcatcaatctgttcatcataagacagagtaagaatttttaacagaaaattctaaaagagatagaagctaggaaagcttctttatatcttgcattaaatgggtagggaaaaaatatgactctcacccatgtcatgtactggaccatctttctctactttttaaagaaaaactaatacaactagaaaaacatcacaacaagccaaataaaaatggagaaaaggagtcattgtccttatacctaatggaacagtttccagaactactttaactatggaagcatttttgaaaataaagtattaataaaatagaaaaaaattattaaatatattgtatccttaatgtatagcaggaaaatagtttcacaaattaattgctattagaaattaccaaatttttattaagtactttaatatgcaatacaaattgaataatagtacaactataagttgatataaagtaagtgcttactggtaatcattaaataactaataacatgacttgttggttaatgttaaacctacagtaagaaatgttatacagatcagataggcattagaacatcaggtgataccttttctgatttctggcattcatggcacaccatttcttaaaagcagattgttgtataataacatatacatgtattagggtttttttcatatatattttttattttagaagaaactagcataattcagggtttatgtgtttatttgtatattaattcatgaaacatgagagtttcatgaactgcagatgtgaaacgctgctatagaatgaatcccttcacctttaccttgttataatgtagtaagattttgttttccttttgactcagaaattttctatgtctatagaggtaatctaatatgttcctactgcctagaagagtaatacataggtgattatatcataaaatagaggtataaagtctttgcttacttctccatgtgggccacagcaagctgcagactgtacagttatgaaaggtaaagatgacttaggctgtgcctaagtgacaaatgtaaaatgttttgtaaataagtgacttacctaagatacataagatattttcatagaaaataatgtattcatagtaaaatactcaaattgataggaccaattttttctggcctaaatgcttatgcctacttcctaatcaattaccagcttgacttaagtaactgcttgagtagtcttctaagagttagtcttcgtaaaataaatggataggtatgtaaatatataatcttacataccctttccagcttcctagaaaggtctactgcttcatcttttacagatgtaaataggtccaaccagagacagtttctggcctttgcatataagaatatagatgtataccacagtattatttcaacaaaatgttatggttctatgtatagttgaaaactctatgatcagcatacaactgtcttttggtaatttttaatgaagtctacatttagccgtcggttttatctttcttaaatctttgacctaaacttttgtaagagcagctaataatttctaagattttccctgtttctttttcctacctttccttttctcataactgattggagaaattaatcagaagtcaaatacaagggacttcataatctagaaaccagataatcagctcccaagtcatgtagctaactatgcatttaaaataagtctgtctctttagttcttaagtcatatatttgtttgttaattacagtaaatgaactttaattggggtttttaaaagacagaattagcgaagtctaatttttataatgaaataagtttttgatattgctctacttggacgattttagtgaccaaaactatggataaaactgcctaagcataacattaatatatttagaatggcattcttcagtgctagtatttgaaattggaattagtacattgtgcattcttagtagtctttatccctagaatcaattctctcagcatcaccaaactgaattggtgaaatagtgctaagattctgggcaataggaagattagtgaatatgatacattgattccagggtgccagggattggctgacattaaggaccagctggctatggtcctcaggctacggtcctcagtattctagtatttgagtagtggaggtaaatccaaaggcgactggttatattttacttctaaatgtgtgctgaagtgtctcttgttcaaaaattcttgatatttagagcttcaagttaccacatttaaaagtaaagacttggcacggtggcacacacctataatcttagcactttgggaggccgaagtggatggatcatatgcagtcaggaatttgagaccagcctggccaacatggtgaaacctcatctttactaaaaatacaaaaattagccgggcgttgtgacgcacacccatagtcccagctaactccggaggctaagacaagagaatcacttgaacttgggagacagaggttgcagtaatctgagatcactccgctgcactccagcctgagtgagagtgagactgtgtctcaaacaaacaaacaaaaaacaaacaaaaaaatttgcattgtaaattgtacctcaaatttgagcagtttttgtgtttgtgtaaattaaagtaaaaagcagtccacaataatgttttgtaatactgcacaccagttctaccagattttgtaactatcagatttaaatgaaaaaagagaaggaagaggctgattgctggagtgttaaagaaatcttggccgggcgtggtggctcacgcttgtaatcccagcactttgggaggccgaggcgggtggatcacgaggtcaggagatcgagaccatcctggctaacacggtgaaaccccgtctctactaaaaatacaaaaaaaaattagccgggcgtgatggcgggcgcctgtagtcccagctactcgggaggctgaggcaagagaatggcgtgaacccgggaggcggagcttgcagtgagccgagattgcgccactgcactcccgcctgggccacagagcgagactccgtctcaaaaaaaaaaaaaaaaaaaaaaaaagaaatctttagaagccacagggctagaagagaagtcaccaaacacctagggacagtcctaggcctagaaagccctttaaagtaatagtgaattgttttaaaattaagttattgagtggcctactgactgccatccaaaaacctttatcaccaaatttgttcagtgtttgctattgggagattgtccatatccctccgtaattaagggccagcaagtaatacgatcttcttacagccaaccttgctcttcccaaagggagaaagtaatacatcattaacctggaatttgtgatataacaggtagccttggttaatgtttaccttttcactatgtaaaaaagaaaaaacacacagcaaatagtgcaaataaaatttggtcttttaaagcattttagcagtagctatgtaaaaaaagttaatggttattattcctaaattttcataagacccttggtagacaaaactatcggttatattatgtatatatgaggttagttaagctgcatttagttaggaacatttaatttttacctaaatgatccttttttcatccagaggtagagattttattgtcattatgaatgttactccccatttagtccaaaatagtgagcttttaagttgtgccaggtacttaacaatagtaaaagctattgtatagatttttattcaatgtgacctataatacatttctgattccttctgtattgaatgtcccagtttccatattaagtgctatgccctgtataacattaatgaatttaatagtgtacaattttgggccaggcatggtggctcacgccagtaatcctggcactttgggaggcagaggcaggcagatcacctgaggtcaggggttcgagatcagcctggccaacatggcaaaatcacatctctactaaaaatacaaaaattagccaggcgtggtggtgcatgcctgtagtcccagctactcaggaggctgaggcaggagaatcgcttgaacccaggaggcggaggttgcagtgagccgagatcatgccattgcactccagcctgggagacagagcaagactctatctcaaaaataaaaataaaaaaaaaattgcgtgcaattttgtattttcatagtcgtatctttttaaaggtatcatgatttcagttgtggtcaggaagtatgtgccttaaatcctctactctagacccaaagtttggagagctatattatttaataagttgtttgtgacagccttgttacctttttcatttgatttgagggagaaagactgtgatcctgacagattccttctcataaaatggcctaatgtgtatcagtctaggacttctggggagggaacctctaccatgcattctgtcccaggatgtcaaagtcataagaatcagggtcccctgaaataaaatcactgaaaagatatgttctgttatatattatttaaaaaatttatctggtgccaccaaagaatgacagcagtttctaaccaacttcatatttatagcatcttatgaagatattgtaaggcttagcatattttgccactggttttctttgtaatataggttgaaagtgagacatgtttgaatacttttgtatgtaaatatctcccattctttttctatctcttcttggtctatatttactaagaattgatatttaagatttgggtgctactagacttttacctaacattagtctttctcaatagttgttgtaaaggatagtattcaatccagtaaatattaaagtgtattagtttaatgaaggttatttatatactgtcataccacaaacctatggtggaaagaacatctgcattcaccagaatgtacttgttcctttggctgtgaataaattggataagacttttttattgtaagttccagctgttggaagatacggggataagattgacattgctgttgcagtattgcaaaaacatgactaaattggttaattatgtctaccgcttatgtttaagagaatcctttcactaacttaaattgttaacattgttgtgatattgagaaagaatattaacctaaacagtcactttacaacaatcatgtaaagacgtgtgcctgcagttgaggttttttgcatttctgagcctgctttgtattcatgagaaacaaaaacataatgggagaaaagttttagataagcagcattgtaagtttttgtaaagtttgggatgtcaaagtattaacgaagggtactgaaaacatacttttacttgggtcaaattactttttatgatctgatttcttaattttctgtatttgaaatcttgcaaattaggaatatctacatctatagataaataagtaaaacttaatggtagaaataagtgtaattcagcaacatgattcaacaatttttatatttaggataagttattgtttattatattaatatcaaatttatatattgccttgtaatgctaaatgctcttaaaagaatatatgggctacttcaattctaccaccttcttccccctcccccaggacgtacaaaagatcttatattaaccaatcctctgtgaattttgccatatcaaacattgtgccttattttaataaaactgttttgttggaatccagttctatattaaagtctctataatgtt

SEQ ID NO: 305568 - DNA, 3411 bp, Homo sapiens
  misc_feature (27)..(27): n is a, c, g, or t
gtctcgacgatctcgagatcggtactnggttgggtgaaacctcatctttactaaaaatacaaaaattagccgggcgttgtgacgcacacccatagtcccagctaactccggaggctaagacaagagaatcacttgaacttgggagacagaggttgcagtaatctgagatcactccgctgcactccagcctgagtgagagtgagactgtgtctcaaacaaacaaacaaaaaacaaacaaaaaaatttgcattgtaaattgtacctcaaatttgagcagtttttgtgtttgtgtaaattaaagtaaaaagcagtccacaataatgttttgtaatactgcacaccagttctaccagattttgtaactatcagatttaaatgaaaaaagagaaggaagaggctgattgctggagtgttaaagaaatcttggccgggcgtggtggctcacgcttgtaatcccagcactttgggaggccgaggcgggtggatcacgaggtcaggagatcgagaccatcctggctaacacggtgaaaccccgtctctactaaaaatacaaaaaaaaattagccgggcgtgatggcgggcgcctgtagtcccagctactcgggaggctgaggcaagagaatggcgtgaacccgggaggcggagcttgcagtgagccgagattgcgccactgcactcccgcctgggccacagagcgagactccgtctcaaaaaaaaaaaaaaaaaaaaaaaaagaaatctttagaagccacagggctagaagagaagtcaccaaacacctagggacagtcctaggcctagaaagccctttaaagtaatagtgaattgttttaaaattaagttattgagtggcctactgactgccatccaaaaacctttatcaccaaatttgttcagtgtttgctattgggagattgtccatatccctccgtaattaagggccagcaagtaatacgatcttcttacagccaaccttgctcttcccaaagggagaaagtaatacatcattaacctggaatttgtgatataacaggtagccttggttaatgtttaccttttcactatgtaaaaaagaaaaaacacacagcaaatagtgcaaataaaatttggtcttttaaagcattttagcagtagctatgtaaaaaaagttaatggttattattcctaaattttcataagacccttggtagacaaaactatcggttatattatgtatatatgaggttagttaagctgcatttagttaggaacatttaatttttacctaaatgatccttttttcatccagaggtagagattttattgtcattatgaatgttactccccatttagtccaaaatagtgagcttttaagttgtgccaggtacttaacaatagtaaaagctattgtatagatttttattcaatgtgacctataatacatttctgattccttctgtattgaatgtcccagtttccatattaagtgctatgccctgtataacattaatgaatttaatagtgtacaattttgggccaggcatggtggctcacgccagtaatcctggcactttgggaggcagaggcaggcagatcacctgaggtcaggggttcgagatcagcctggccaacatggcaaaatcacatctctactaaaaatacaaaaattagccaggcgtggtggtgcatgcctgtagtcccagctactcaggaggctgaggcaggagaatcgcttgaacccaggaggcggaggttgcagtgagccgagatcatgccattgcactccagcctgggagacagagcaagactctatctcaaaaataaaaataaaaaaaaaattgcgtgcaattttgtattttcatagtcgtatctttttaaaggtatcatgatttcagttgtggtcaggaagtatgtgccttaaatcctctactctagacccaaagtttggagagctatattatttaataagttgtttgtgacagccttgttacctttttcatttgatttgagggagaaagactgtgatcctgacagattccttctcataaaatggcctaatgtgtatcagtctaggacttctggggagggaacctctaccatgcattctgtcccaggatgtcaaagtcataagaatcagggtcccctgaaataaaatcactgaaaagatatgttctgttatatattatttaaaaaatttatctggtgccaccaaagaatgacagcagtttctaaccaacttcatatttatagcatcttatgaagatattgtaaggcttagcatattttgccactggttttctttgtaatataggttgaaagtgagacatgtttgaatacttttgtatgtaaatatctcccattctttttctatctcttcttggtctatatttactaagaattgatatttaaaaaacagttcactaatgaactctacatattattgaacactcacagggcaatattgatttgggtgctactagacttttacctaacattagtctttctcaatagttgttgtaaaggatagtattcaatccagtaaatattaaagtgtattagtttaatgaaggttatttatatactgtcataccacaaacctatggtggaaagaacatctgcattcaccagaatgtacttgttcctttggctgtgaataaattggataagacttttttattgtaagttccagctgttggaagatacggggataagattgacattgctgttgcagtattgcaaaaacatgactaaattggttaattatgtctaccgcttatgtttaagagaatcctttcactaacttaaattgttaacattgttgtgatattgagaaagaatattaacctaaacagtcactttacaacaatcatgtaaagacgtgtgcctgcagttgaggttttttgcatttctgagcctgctttgtattcatgagaaacaaaaacataatgggagaaaagttttagataagcagcattgtaagtttttgtaaagtttgggatgtcaaagtattaacgaagggtactgaaaacatacttttacttgggtcaaattactttttatgatctgatttcttaattttctgtatttgaaatcttgcaaattaggaatatctacatctatagataaataagtaaaacttaatggtagaaataagtgtaattcagcaacatgattcaacaatttttatatttaggataagttattgtttattatattaatatcaaatttatatattgccttgtaatgctaaatgctcttaaaagaatatatgggctacttcaattctaccaccttcttccccctcccccaggacgtacaaaagatcttatattaaccaatcctctgtgaattttgccatatcaaacattgtgccttattttaataaaactgttttgttggaatccagttctatattaaagtctctataatgtt

SEQ ID NO: 305569 - DNA, 4787 bp, Homo sapiens
ctcggttcaggttccggggcgccgcagagctgccggcctctggaccgcgcgcggcgctctggggaatccggcgccacgcgccgtgcggtggccaggatggaggaggccggagcagcggtggtcacggccggggaggccgaactgaactggtcccgcctcagcgtgtccaccgagacgctggagtctgagctggaggcgcggggggaggagcggcgcggggcgcgggaggcgctgctgcggctgctgctgcctcacaaccgtctggtgtcgctgccacgggcgctgggcagcggcttcccgcacctccagctgctggacgtgagcggcaacgcgttgaccgcgctcgggccggagctgctcgctctgcgcggcctgcgcacgctgctggccaagaacaaccggctcggcgggcccagtgcgctgcccaagggcctggcccagtcgccgctctgccgcagcctccaggtgctcaacctcagcggcaactgtttccaggaggtgcctgcctcgctcttagagctgcgcgcgctgcagaccctgagcctgggcggcaaccaactgcagagcatcccggctgagatcgagaacttgcagagtttagagtgtttatatcttggaggaaatttcattaaagaaatcccaccagaattaggaaatctgccttctctgaattatttggtattatgtgacaacaaaatccaaagcatacctcctcaactttcacagttacattcacttcgttccctaagtcttcacaataacttgctgacatatctgcctcgagagatcctcaaccttattcatttggaagagttgagtttacgaggaaatccattggttgttcgttttgttagagatttaacctatgatcctccaactctcctggaattagctgcacggaccattaagattcgaaatatttcctacactccctatgatcttcctggaaatcttcttagatacttgggttcagccagcaattgcccaaacccaaagtgtggaggagtctactttgactgctgtgtcagacaaattaaatttgtggacttctgtgggaagtatcgcctcccactgatgcactacttgtgttcaccagaatgttcttccccttgcagttctgcctctcacagctccacttcccagagtgaatctgactcagaagatgaagctagtgttgctgcacgcagaatgcagaaagttcttcttggttgaacaggagtgcacagtgttgtgaaatacttaaaaaactgagcaaaatggttagacaagaaaatagagcttgaagttcactagaaatcttatcttcatcttaagtgttcatcaaagagtctgggatgatataaaacattttgtgtttcatctacccattcagcaagaatgagtccagtcccatgtttagattattttaacataatttgtgaatgatagtttcacatttggctgatggtttgcagttttcactcaagttttgcatgaatcacaaagcagaatggtaccttttgaagagcagttctgcaataagtcatgagtagtataacttttggacattgagatggagaaagtgagaaattatcaaagctataattgccagagttgcccttgggtttaggtagaacactgtataccatatatactatataccatatatactatatataccatatatattatatgccataaacaggattaaccctcccttttctaattgcctgtatgtctagattacagaactattcaaagaagctcacagatggttacatgggacaaacctttctgacaaactaactggtaaagtaaggcatataacatttacatgagatattaaaactttttcattattatcctttgttctatatgattgctattaaccttatgtaatctagcaatgactgttatagtgccttaatccagcaaggatataaaaatgtattcaagaagtaatgccagagcaacctataacctgacataccatgcagaacattgtaaaatattctttaacagaactaggtaaataactgtgtatctaatatccgaaaaaaaaaaaaaaaaaaaaaaaaaaaaaaaaaaaaaaaaaaaaaaaaaaaaaaaaaaaaaaaaaaaaaaaaaaaaagaaatctttagaagccacagggctagaagagaagtcaccaaacacctagggacagtcctaggcctagaaagccctttaaagtaatagtgaattgttttaaaattaagttattgagtggcctactgactgccatccaaaaacctttatcaccaaatttgttcagtgtttgctattgggagattgtccatatccctccgtaattaagggccagcaagtaatacgatcttcttacagccaaccttgctcttcccaaagggagaaagtaatacatcattaacctggaatttgtgatataacaggtagccttggttaatgtttaccttttcactatgtaaaaaagaaaaaacacacagcaaatagtgcaaataaaatttggtcttttaaagcattttagcagtagctatgtaaaaaaagttaatggttattattcctaaattttcataagacccttggtagacaaaactatcggttatattatgtatatatgaggttagttaagctgcatttagttaggaacatttaatttttacctaaatgatccttttttcatccagaggtagagattttattgtcattatgaatgttactccccatttagtccaaaatagtgagcttttaagttgtgccaggtacttaacaatagtaaaagctattgtatagatttttattcaatgtgacctataatacatttctgattccttctgtattgaatgtcccagtttccatattaagtgctatgccctgtataacattaatgaatttaatagtgtacaattttgggccaggcatggtggctcacgccagtaatcctggcactttgggaggcagaggcaggcagatcacctgaggtcaggggttcgagatcagcctggccaacatggcaaaatcacatctctactaaaaatacaaaaattagccaggcgtggtggtgcatgcctgtagtcccagctactcaggaggctgaggcaggagaatcgcttgaacccaggaggcggaggttgcagtgagccgagatcatgccattgcactccagcctgggagacagagcaagactctatctcaaaaataaaaataaaaaaaaaattgcgtgcaattttgtattttcatagtcgtatctttttaaaggtatcatgatttcagttgtggtcaggaagtatgtgccttaaatcctctactctagacccaaagtttggagagctatattatttaataagttgtttgtgacagccttgttacctttttcatttgatttgagggagaaagactgtgatcctgacagattccttctcataaaatggcctaatgtgtatcagtctaggacttctggggagggaacctctaccatgcattctgtcccaggatgtcaaagtcataagaatcagggtcccctgaaataaaatcactgaaaagatatgttctgttatatattatttaaaaaatttatctggtgccaccaaagaatgacagcagtttctaaccaacttcatatttatagcatcttatgaagatattgtaaggcttagcatattttgccactggttttctttgtaatataggttgaaagtgagacatgtttgaatacttttgtatgtaaatatctcccattctttttctatctcttcttggtctatatttactaagaattgatatttaaaaaacagttcactaatgaactctacatattattgaacactcacagggcaatattgatttgggtgctactagacttttacctaacattagtctttctcaatagttgttgtaaaggatagtattcaatccagtaaatattaaagtgtattagtttaatgaaggttatttatatactgtcataccacaaacctatggtggaaagaacatctgcattcaccagaatgtacttgttcctttggctgtgaataaattggataagacttttttattgtaagttccagctgttggaagatacggggataagattgacattgctgttgcagtattgcaaaaacatgactaaattggttaattatgtctaccgcttatgtttaagagaatcctttcactaacttaaattgttaacattgttgtgatattgagaaagaatattaacctaaacagtcactttacaacaatcatgtaaagacgtgtgcctgcagttgaggttttttgcatttctgagcctgctttgtattcatgagaaacaaaaacataatgggagaaaagttttagataagcagcattgtaagtttttgtaaagtttgggatgtcaaagtattaacgaagggtactgaaaacatacttttacttgggtcaaattactttttatgatctgatttcttaattttctgtatttgaaatcttgcaaattaggaatatctacatctatagataaataagtaaaacttaatggtagaaataagtgtaattcagcaacatgattcaacaatttttatatttaggataagttattgtttattatattaatatcaaatttatatattgccttgtaatgctaaatgctcttaaaagaatatatgggctacttcaattctaccaccttcttccccctcccccaggacgtacaaaagatcttatattaaccaatcctctgtgaattttgccatatcaaacattgtgccttattttaataaaactgttttgttggaatccagttctatattaaagtctctataatgtt

SEQ ID NO: 305570 - DNA, 3590 bp, Homo sapiens
ggatataacaggtagccttgttaatgtttacgttgtcactatgtaaattaagtgtaatcacacaggcaaagggtgcaaatagaatttggtctttgtaaagcatgtttaggcagtagcctatgtaagaaaagttaatggttattattcctaaattttcataagacccttggtagacaaaactatcggttatattatgtatatatgaggttagttaaagctgcatttagttaggaacatctgagccgtttagctcaaagagtcctttcctgactgctatcgcctagatatctgtaggattaccgaagtataccgcacctaccgcagtgtagatccgacagtgacgctagatgacgtattctgatgatatgatcggacatgcgatatcattaagcgacagtatatgctagcctactatgctagaagagaccgagtgccagcgggacctatgatacatggtagcaggtccgtctcaatattcgtatatgcacactattacatcagaaagagagcaatggccggtatcacagcacaaatgacaccgtgagatattcgtgaccaattttctggcgccgcaggcgtagtgtgtgcgtctacagcgtctcgtgttactccatgcacatcttgtgagacgccagaggcgcgaggtgcatactcagcgtgtacagtgaagatgcgttgacacattccatgcctgacccaggatgggacccacttatatcatctactatacaaaaaaaaattagccgggcgtgatggcgggcgcctgtagtcccagctactcgggaggctgaggcaagagaatggcgtgaacccgggaggcggagcttgcagtgagccgagattgcgccactgcactcccgcctgggccacagagcgagactccgtctcaaaaaaaaaaaaaaaaaaaaaaaaagaaatctttagaagccacagggctagaagagaagtcaccaaacacctagggacagtcctaggcctagaaagccctttaaagtaatagtgaattgttttaaaattaagttattgagtggcctactgactgccatccaaaaacctttatcaccaaatttgttcagtgtttgctattgggagattgtccatatccctccgtaattaagggccagcaagtaatacgatcttcttacagccaaccttgctcttcccaaagggagaaagtaatacatcattaacctggaatttgtgatataacaggtagccttggttaatgtttaccttttcactatgtaaaaaagaaaaaacacacagcaaatagtgcaaataaaatttggtcttttaaagcattttagcagtagctatgtaaaaaaagttaatggttattattcctaaattttcataagacccttggtagacaaaactatcggttatattatgtatatatgaggttagttaagctgcatttagttaggaacatttaatttttacctaaatgatccttttttcatccagaggtagagattttattgtcattatgaatgttactccccatttagtccaaaatagtgagcttttaagttgtgccaggtacttaacaatagtaaaagctattgtatagatttttattcaatgtgacctataatacatttctgattccttctgtattgaatgtcccagtttccatattaagtgctatgccctgtataacattaatgaatttaatagtgtacaattttgggccaggcatggtggctcacgccagtaatcctggcactttgggaggcagaggcaggcagatcacctgaggtcaggggttcgagatcagcctggccaacatggcaaaatcacatctctactaaaaatacaaaaattagccaggcgtggtggtgcatgcctgtagtcccagctactcaggaggctgaggcaggagaatcgcttgaacccaggaggcggaggttgcagtgagccgagatcatgccattgcactccagcctgggagacagagcaagactctatctcaaaaataaaaataaaaaaaaaattgcgtgcaattttgtattttcatagtcgtatctttttaaaggtatcatgatttcagttgtggtcaggaagtatgtgccttaaatcctctactctagacccaaagtttggagagctatattatttaataagttgtttgtgacagccttgttacctttttcatttgatttgagggagaaagactgtgatcctgacagattccttctcataaaatggcctaatgtgtatcagtctaggacttctggggagggaacctctaccatgcattctgtcccaggatgtcaaagtcataagaatcagggtcccctgaaataaaatcactgaaaagatatgttctgttatatattatttaaaaaatttatctggtgccaccaaagaatgacagcagtttctaaccaacttcatatttatagcatcttatgaagatattgtaaggcttagcatattttgccactggttttctttgtaatataggttgaaagtgagacatgtttgaatacttttgtatgtaaatatctcccattctttttctatctcttcttggtctatatttactaagaattgatatttaaaaaacagttcactaatgaactctacatattattgaacactcacagggcaatattgatttgggtgctactagacttttacctaacattagtctttctcaatagttgttgtaaaggatagtattcaatccagtaaatattaaagtgtattagtttaatgaaggttatttatatactgtcataccacaaacctatggtggaaagaacatctgcattcaccagaatgtacttgttcctttggctgtgaataaattggataagacttttttattgtaagttccagctgttggaagatacggggataagattgacattgctgttgcagtattgcaaaaacatgactaaattggttaattatgtctaccgcttatgtttaagagaatcctttcactaacttaaattgttaacattgttgtgatattgagaaagaatattaacctaaacagtcactttacaacaatcatgtaaagacgtgtgcctgcagttgaggttttttgcatttctgagcctgctttgtattcatgagaaacaaaaacataatgggagaaaagttttagataagcagcattgtaagtttttgtaaagtttgggatgtcaaagtattaacgaagggtactgaaaacatacttttacttgggtcaaattactttttatgatctgatttcttaattttctgtatttgaaatcttgcaaattaggaatatctacatctatagataaataagtaaaacttaatggtagaaataagtgtaattcagcaacatgattcaacaatttttatatttaggataagttattgtttattatattaatatcaaatttatatattgccttgtaatgctaaatgctcttaaaagaatatatgggctacttcaattctaccaccttcttccccctcccccaggacgtacaaaagatcttatattaaccaatcctctgtgaattttgccatatcaaacattgtgccttattttaataaaactgttttgttggaatccagttctatattaaagtctctataatgtt

SEQ ID NO: 305571 - DNA, 2977 bp, Homo sapiens
ggcggccgagggggagcccgcgccgcggctgcagctgccaagggagcgttccgagcccacgtcaggggaggtgtcgggataaatagggtcccgcaatggccgtggctggctgcgctccgagctgcggagtccgggactggagctgcccgggcgggttcgcgccccgaaggctgagagctggcgctgctcgtgccctgtgtgccagacggcggagctccgcggccggaccccgcggccccgctttgctgccgactggagtttgggggaagaaactctcctgcgccccagaggatttcttcctcggcgaagggacagcgaaagatgagggtggcaggaagagaagggcgctttctgtctgccggggtcgcagcgcgagagggcagtgccatgttcctctccatcctagtggcgctgtgcctgtggctgcacctggcgctgggcgtgcgcggcgcgccctgcgaggcggtgcgcatccctatgtgccggcacatgccctggaacatcacgcggatgcccaaccacctgcaccacagcacgcaggagaacgccatcctggccatcgagcagtacgaggagctggtggacgtgaactgcagcgccgtgctgcgcttcttcctctgtgccatgtacgcgcccatttgcaccctggagttcctgcacgaccctatcaagccgtgcaagtcggtgtgccaacgcgcgcgcgacgactgcgagcccctcatgaagatgtacaaccacagctggcccgaaagcctggcctgcgacgagctgcctgtctatgaccgtggcgtgtgcatctcgcctgaagccatcgtcacggacctcccggaggatgttaagtggatagacatcacaccagacatgatggtacaggaaaggcctcttgatgttgactgtaaacgcctaagccccgatcggtgcaagtgtaaaaaggtgaagccaactttggcaacgtatctcagcaaaaactacagctatgttattcatgccaaaataaaagctgtgcagaggagtggctgcaatgaggtcacaacggtggtggatgtaaaagagatcttcaagtcctcatcacccatccctcgaactcaagtcccgctcattacaaattcttcttgccagtgtccacacatcctgccccatcaagatgttctcatcatgtgttacgagtggcgctcaaggatgatgcttcttgaaaattgcttagttgaaaaatggagagatcagcttagtaaaagatccatacagtgggaagagaggctgcaggaacagcggagaacagttcaggacaagaagaaaacagccgggcgcaccagtcgtagtaatccccccaaaccaaagggaaagcctcctgctcccaaaccagccagtcccaagaagaacattaaaactaggagtgcccagaagagaacaaacccgaaaagagtgtgagctaactagtttccaaagcggagacttccgacttccttacaggatgaggctgggcattgcctgggacagcctatgtaaggccatgtgccccttgccctaacaactcactgcagtgctcttcatagacacatcttgcagcatttttcttaaggctatgcttcagtttttctttgtaagccatcacaagccatagtggtaggtttgccctttggtacagaaggtgagttaaagctggtggaaaaggcttattgcattgcattcagagtaacctgtgtgcatactctagaagagtagggaaaataatgcttgttacaattcgacctaatatgtgcattgtaaaataaatgccatatttcaaacaaaacacgtaatttttttacagtatgttttattaccttttgatatctgttgttgcaatgttagtgatgttttaaaatgtgatcgaaaatataatgcttctaagaaggaacagtagtggaatgaatgtctaaaagatctttatgtgtttatggtctgcagaaggatttttgtgatgaaaggggattttttgaaaaatctagagaagtagcatatggaaaattataatgtgtcttttttacaatgacttcagctctgtttttagctagaaactctaaaaacaaaaataataataaagaaaaataaataaaaaggagaggcagacaatgtctggattcctgttttttggttacctgatttccatgatcatgatgcttcttgtcaacaccctcttaagcagcaccagaaacagtgagtttgtctgtaccattaggagttaggtactaattagttggctaatgctcaagtattttatacccacaagagaggtatgtcactcatcttacttcccaggacatccaccctgagaataatttgacaagcttaaaaatggccttcatgtgagtgccaaattttgtttttcttcatttaaatattttctttgcctaaatacatgtgagaggagttaaatataaatgtacagagaggaaagttgaggttccacctctgaaatgagaattacttgacagttgggatactttaatcagaaaaaaagaacttatcttgcagcattttatcaacaaatttcataattgtggacaattggaggcatttattttaaaaaacaattttattggccttttgctaacacagtaagcatgtattctctataaggcattcaataaatgcacaacgcccaaaggaaataaaatcctatctaatcctactctccactacacagaggtaatcactattagtattttggcatattattctccaggtgtttcttatgcacttataaaatgatttgaacaaataaaactaggaacctgctatacatgtgtttcataacctgcctcctttgcttggccctttattgagataagttttcctgtcaagaaagcagaaaccatctcatttctaacagctgtgttatattccatagtatgcattactcaacaaactgttgtgctattggatacttaggtggtttcttcactgacaatactgaataaacatctcaatagtcaaa

SEQ ID NO: 305572 - DNA, 1908 bp, Homo sapiens
ggcggccgagggggagcccgcgccgcggctgcagctgccaagggagcgttccgagcccacgtcaggggaggtgtcgggataaatagggtcccgcaatggccgtggctggctgcgctccgagctgcggagtccgggactggagctgcccgggcgggttcgcgccccgaaggctgagagctggcgctgctcgtgccctgtgtgccagacggcggagctccgcggccggaccccgcggccccgctttgctgccgactggagtttgggggaagaaactctcctgcgccccagaggatttcttcctcggcgaagggacagcgaaagatgagggtggcaggaagagaagggcgctttctgtctgccggggtcgcagcgcgagagggcagtgccatgttcctctccatcctagtggcgctgtgcctgtggctgcacctggcgctgggcgtgcgcggcgcgccctgcgaggcggtgcgcatccctatgtgccggcacatgccctggaacatcacgcggatgcccaaccacctgcaccacagcacgcaggagaacgccatcctggccatcgagcagtacgaggagctggtggacgtgaactgcagcgccgtgctgcgcttcttcctctgtgccatgtacgcgcccatttgcaccctggagttcctgcacgaccctatcaagccgtgcaagtcggtgtgccaacgcgcgcgcgacgactgcgagcccctcatgaagatgtacaaccacagctggcccgaaagcctggcctgcgacgagctgcctgtctatgaccgtggcgtgtgcatctcgcctgaagccatcgtcacggacctcccggaggatgttaagtggatagacatcacaccagacatgatggtacaggaaaggcctcttgatgttgactgtaaacgcctaagccccgatcggtgcaagtgtaaaaaggtgaagccaactttggcaacgtatctcagcaaaaactacagctatgttattcatgccaaaataaaagctgtgcagaggagtggctgcaatgaggtcacaacggtggtggatgtaaaagagatcttcaagtcctcatcacccatccctcgaactcaagtcccgctcattacaaattcttcttgccagtgtccacacatcctgccccatcaagatgttctcatcatgtgttacgagtggcgctcaaggatgatgcttcttgaaaattgcttagttgaaaaatggagagatcagcttagtaaaagatccatacagtgggaagagaggctgcaggaacagcggagaacagttcaggacaagaagaaaacagccgggcgcaccagtcgtagtaatccccccaaaccaaagggaaagcctcctgctcccaaaccagccagtcccaagaagaacattaaaactaggagtgcccagaagagaacaaacccgaaaagagtgtgagctaactagtttccaaagcggagacttccgacttccttacaggatgaggctgggcattgcctgggacagcctatgtaaggccatgtgccccttgccctaacaactcactgcagtgctcttcatagacacatcttgcagcatttttcttaaggctatgcttcagtttttctttgtaagccatcacaagccatagtggtaggtttgccctttggtacagaaggtgagttaaagctggtgggacgaagatgcgccagtcttgctcccatcaggacattttgaaatagtctttggtattactagttattgtgctttgaaacagaaacttgcagaatttctgtagtagtgctacataaagatataaataagaaaaatgcacttggaataagttacatttagctgcttttgcataattttcaaaactacagtgtatgcctacgtcacagttttatgagccagtatatttcctttttccacttaatc

SEQ ID NO: 305573 - DNA, 2648 bp, Homo sapiens
tggggaggggatgggctggagctccgggcagtgtgcgaggcgcacgcacaggagcctgcactctgcgtcccgcaccccagcagccgcgccatgagccggagtctcttgctccggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagtta

SEQ ID NO: 305574 - DNA, 5247 bp, Homo sapiens
tggggaggggatgggctggagctccgggcagtgtgcgaggcgcacgcacaggagcctgcactctgcgtcccgcaccccagcagccgcgccatgagccggagtctcttgctccggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggcagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagagtgaagaatcttaatgcttgtaatttaaacatttgttcctggagttttgatttggtggatgtgatggttggttttatttgtcagtttggttgggctatagcacacagttatttaatcaaacagtaatctaggtgtggctgtgaaggtattttgtagatgtgattaacatctacaatcagttgactttaagtgaaagagattacttaaataatttgggtgagctgcacctgattagttgaaaggcctcaagaacaaacactgcagtttcctggaaaagaagaaactttgcctcaagactatagccatcgactcctgcctgagtttccagcctgctagtctgccctatggatttgaagtttgccaaccccaacaattgtgtgaattaatttctaaaaataaagctatatacagccatcctttggtatttgtgggggatttgtttcaggatctctacagataccaaaatctgtggttcctcaagtcctttatatgaagtggtatagtatttgcatataacctatgtgcaatctcctgtataacttcaatcatctctagattacttataatacctaatacagtgtaaatgctagttgttatactgtattttttct

SEQ ID NO: 305575 - DNA, 5049 bp, Homo sapiens
tggggaggggatgggctggagctccgggcagtgtgcgaggcgcacgcacaggagcctgcactctgcgtcccgcaccccagcagccgcgccatgagccggagtctcttgctccggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggcagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagagtgaagaatcttaatgcttgtaatttaaacatttgttcctggagttttgatttggtggatgtgatggttggttttatttgtcagtttggttgggctatagcacacagttatttaatcaaacagtaatctaggtgtggctgtgaaggtattttgtagatgtgattaacatctacaatcagttgactttaagtgaaagagattacttaaataatttgggtgagctgcacctgattagttgaaaggcctcaagaacaaacactgcagtttcctggaaaagaagaaactttgcctcaagactatagccatcgactcctgcctgagtttccagcctgctagtctgccctatggatttgaagtttgccaaccccaacaattgtgtgaattaatttctaaaaataaagctatatacagcc

SEQ ID NO: 305576 - DNA, 5136 bp, Homo sapiens
tggggaggggatgggctggagctccgggcagtgtgcgaggcgcacgcacaggagcctgcactctgcgtcccgcaccccagcagccgcgccatgagccggagtctcttgctccggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaagatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggcagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagagtgaagaatcttaatgcttgtaatttaaacatttgttcctggagttttgatttggtggatgtgatggttggttttatttgtcagtttggttgggctatagcacacagttatttaatcaaacagtaatctaggtgtggctgtgaaggtattttgtagatgtgattaacatctacaatcagttgactttaagtgaaagagattacttaaataatttgggtgagctgcacctgattagttgaaaggcctcaagaacaaacactgcagtttcctggaaaagaagaaactttgcctcaagactatagccatcgactcctgcctgagtttccagcctgctagtctgccctatggatttgaagtttgccaaccccaacaattgtgtgaattaatttctaaaaataaagctatatacagccatcctttggtatttgtgggggatttgtttcaggatctctacagataccaaaatctgtggttcctcaagtcctttatatgaagtggtatagtatttgcatataacctatgtgcaatctcctgtataacttcaatcatctctagattacttataatacctaatacagtgtaaatgctagttgttatactgtattttttct

SEQ ID NO: 305577 - DNA, 5113 bp, Homo sapiens
tggggaggggatgggctggagctccgggcagtgtgcgaggcgcacgcacaggagcctgcactctgcgtcccgcaccccagcagccgcgccatgagccggagtctcttgctccggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggcagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagagtgaagaatcttaatgcttgtaatttaaacatttgttcctggagttttgatttggtggatgtgatggttggttttatttgtcagtttggttgggctatagcacacagttatttaatcaaacagtaatctaggtgtggctgtgaaggtattttgtagatgtgattaacatctacaatcagttgactttaagtgaaagagattacttaaataatttgggtgagctgcacctgattagttgaaaggcctcaagaacaaacactgcagtttcctggaaaagaagaaactttgcctcaagactatagccatcgactcctgcctgagtttccagcctgctagtctgccctatggatttgaagtttgccaaccccaacaattgtgtgaattaatttctaaaaataaagctatatacagcccatagtgaatttaaaaaaacctttgagggggggccctgttcccaaattttcccttatagtgaac

SEQ ID NO: 305578 - DNA, 5103 bp, Homo sapiens
tggggaggggatgggctggagctccgggcagtgtgcgaggcgcacgcacaggagcctgcactctgcgtcccgcaccccagcagccgcgccatgagccggagtctcttgctccggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggcagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagagtgaagaatcttaatgcttgtaatttaaacatttgttcctggagttttgatttggtggatgtgatggttggttttatttgtcagtttggttgggctatagcacacagttatttaatcaaacagtaatctaggtgtggctgtgaaggtattttgtagatgtgattaacatctacaatcagttgactttaagtgaaagagattacttaaataatttgggtgagctgcacctgattagttgaaaggcctcaagaacaaacactgcagtttcctggaaaagaagaaactttgcctcaagactatagccatcgactcctgcctgagtttccagcctgctagtctgccctatggatttgaagtttgccaaccccaacaattgtgtgaattaatttctaaaaataaagctatatacagccatcctttggtatttgtgggggatttgtttcaggatctctacagataccaaaatctgtggttcctcaagtcctttatatgaagtggtatagtatttgcatataacctatgtgcaatctcctgtataacttcaatcatctctagattacttataatacctaatacagtgtaaatgctagttgttatactgtattttttct

SEQ ID NO: 305579 - DNA, 4938 bp, Homo sapiens
tggggaggggatgggctggagctccgggcagtgtgcgaggcgcacgcacaggagcctgcactctgcgtcccgcaccccagcagccgcgccatgagccggagtctcttgctccggttcttgctgttcctgctcctgctcccgccgctccccgtcctgctcgcggacccaggggcgcccacgccagctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggcagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagagtgaagaatcttaatgcttgtaatttaaacatttgttcctggagttttgatttggtggatgtgatggttggttttatttgtcagtttggttgggctatagcacacagttatttaatcaaacagtaatctaggtgtggctgtgaaggtattttgtagatgtgattaacatctacaatcagttgactttaagtgaaagagattacttaaataatttgggtgagctgcacctgattagttgaaaggcctcaagaacaaacactgcagtttcctggaaaagaagaaactttgcctcaagactatagccatcgactcctgcctgagtttccagcctgctagtctgccctatggatttgaagtttgccaaccccaacaattgtgtgaattaatttctaaaaataaagctatatacagccatcctttggtatttgtgggggatttgtttcaggatctctacagataccaaaatctgtggttcctcaagtcctttatatgaagtggtatagtatttgcatataacctatgtgcaatctcctgtataacttcaatcatctctagattacttataatacctaatacagtgtaaatgctagttgttatactgtattttttct

SEQ ID NO: 305580 - DNA, 5189 bp, Homo sapiens
cctaagtggaactgctccgggcccaagtccatggaggtctcctgctaggcggcctgcacagctgccgcgcccggttctgtctctgtcatgtgtcattgctcccaaggttccatccttacccacttccccataggtgctactctgttccaccctggcccttgtcctcagtgccccatcttccaccctggctacttctggttctggtaggagggaccaactgagtgactgccattgcccctgcagctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggcagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagagtgaagaatcttaatgcttgtaatttaaacatttgttcctggagttttgatttggtggatgtgatggttggttttatttgtcagtttggttgggctatagcacacagttatttaatcaaacagtaatctaggtgtggctgtgaaggtattttgtagatgtgattaacatctacaatcagttgactttaagtgaaagagattacttaaataatttgggtgagctgcacctgattagttgaaaggcctcaagaacaaacactgcagtttcctggaaaagaagaaactttgcctcaagactatagccatcgactcctgcctgagtttccagcctgctagtctgccctatggatttgaagtttgccaaccccaacaattgtgtgaattaatttctaaaaataaagctatatacagccatcctttggtatttgtgggggatttgtttcaggatctctacagataccaaaatctgtggttcctcaagtcctttatatgaagtggtatagtatttgcatataacctatgtgcaatctcctgtataacttcaatcatctctagattacttataatacctaatacagtgtaaatgctagttgttatactgtattttttct

SEQ ID NO: 305581 - DNA, 2452 bp, Homo sapiens
tggggaggggatgggctggagctccgggcagtgtgcgaggcgcacgcacaggagcctgcactctgcgtcccgcaccccagcagccgcgccatgagccggagtctcttgctccggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctgcgtggtctcccttgggggccttgggcactcgggcgcgacaatttttccgccccaaaagcggaaaagacccaagggttggggcccttcccgcgttataattttttcccccgccccaaaaaaagaactttcctttgggctttcccaag

SEQ ID NO: 305582 - DNA, 2627 bp, Homo sapiens
  misc_feature (2532)..(2532): n is a, c, g, or t
  misc_feature (2539)..(2539): n is a, c, g, or t
  misc_feature (2543)..(2543): n is a, c, g, or t
  misc_feature (2569)..(2569): n is a, c, g, or t
  misc_feature (2571)..(2571): n is a, c, g, or t
  misc_feature (2577)..(2577): n is a, c, g, or t
  misc_feature (2590)..(2590): n is a, c, g, or t
  misc_feature (2593)..(2593): n is a, c, g, or t
  misc_feature (2598)..(2598): n is a, c, g, or t
  misc_feature (2607)..(2607): n is a, c, g, or t
tggggaggggatgggctggagctccgggcagtgtgcgaggcgcacgcacaggagcctgcactctgcgtcccgcaccccagcagccgcgccatgagccggagtctcttgctccggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctgtctagccagggggtggcaagagcgggaaatctcctaggagaggagctgcatccatggacaacaacagtaaatttgctaagagccgaagccgagctgccaagaagaaagcatctctccagtctggccaggagggtgctggggacagccctggatcacagttttccaaatggcctgcaagtcctggctctcacagcgatgatgactttgataactggagtacatttcnccctcgnactngctcaatgctagtactattagtgggngnctctcncccattatgccgnacngatgntcttggagnagggatgtgctttcttgctg

SEQ ID NO: 305583 - DNA, 2510 bp, Homo sapiens
  misc_feature (2415)..(2415): n is a, c, g, or t
  misc_feature (2422)..(2422): n is a, c, g, or t
  misc_feature (2426)..(2426): n is a, c, g, or t
  misc_feature (2452)..(2452): n is a, c, g, or t
  misc_feature (2454)..(2454): n is a, c, g, or t
  misc_feature (2460)..(2460): n is a, c, g, or t
  misc_feature (2473)..(2473): n is a, c, g, or t
  misc_feature (2476)..(2476): n is a, c, g, or t
  misc_feature (2481)..(2481): n is a, c, g, or t
  misc_feature (2490)..(2490): n is a, c, g, or t
tggggaggggatgggctggagctccgggcagtgtgcgaggcgcacgcacaggagcctgcactctgcgtcccgcaccccagcagccgcgccatgagccggagtctcttgctccggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctcagtctggccaggagggtgctggggacagccctggatcacagttttccaaatggcctgcaagtcctggctctcacagcgatgatgactttgataactggagtacatttcnccctcgnactngctcaatgctagtactattagtgggngnctctcncccattatgccgnacngatgntcttggagnagggatgtgctttcttgctg

SEQ ID NO: 305584 - DNA, 2410 bp, Homo sapiens
tggggaggggatgggctggagctccgggcagtgtgcgaggcgcacgcacaggagcctgcactctgcgtcccgcaccccagcagccgcgccatgagccggagtctcttgctccggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctgccagccagcagctaggactgggagagataggtagaagaaggactgctgtgattaggactacggaggctccagggtgggagtagttccctgctaaggggtctgct

SEQ ID NO: 305585 - DNA, 2405 bp, Homo sapiens
tggggaggggatgggctggagctccgggcagtgtgcgaggcgcacgcacaggagcctgcactctgcgtcccgcaccccagcagccgcgccatgagccggagtctcttgctccggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctgtctagccagtcccatcaagtgtccagctctcagcagagagggtggttcctctttgcagcacttgtcccatcatttccttagttctcaacagagacgaac

SEQ ID NO: 305586 - DNA, 957 bp, Homo sapiens
caacaggatgcagaaggcaatcactgccctggcacctagcaccatgaagatcaagatcattgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaaaaaaaaaaacaaaccaaaccacacacaagaaacagaggg

SEQ ID NO: 305587 - DNA, 763 bp, Homo sapiens
  misc_feature (748)..(748): n is a, c, g, or t
caacaggatgcagaaggcaatcactgccctggcacctagcaccatgaagatcaagatcattgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtcgcgttntgggtcctctgacgc

SEQ ID NO: 305588 - DNA, 766 bp, Homo sapiens
cccacgcgtccgcggacgcgtgggtcgacccacgcgtccggaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaacaaataaaagtgctgccgtaaccaaaaaaaaaaaaacaataaaccaaccaacgcactaagaacccataaaaacaaacatacacaaaaaaaaaacaaaagggggggggcccccaaaaattccccc

SEQ ID NO: 305589 - DNA, 808 bp, Homo sapiens
caacaggatgcagaaggcaatcactgccctggcacctagcaccatgaagatcaagatcattgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttgggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaaaaaaaaaaacaaaccaaaccacacacaagaaacagaggg

SEQ ID NO: 305590 - DNA, 566 bp, Homo sapiens
caacaggatgcagaaggcaatcactgccctggcacctagcaccatgaagatcaagatcattgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtcatggactttcggcgtgtcataggatcgtctagagcag

SEQ ID NO: 305591 - DNA, 671 bp, Homo sapiens
  misc_feature (41)..(41): n is a, c, g, or t
cccacgcgtccgcggacgcgtgggtcgacccacgcgtccgnttgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaacaaataaaagtgctgccgtaaccaaaaaaaaaaaaacaataaaccaaccaacgcactaagaacccataaaaacaaacatacacaaaaaaaaaacaaaagggggggggcccccaaaaattccccc

SEQ ID NO: 305592 - DNA, 550 bp, Homo sapiens
  misc_feature (418)..(418): n is a, c, g, or t
tccaggtcttcatccccatcctcaggtttctctgcgtctggatcaggtacgtactcaggctcatcatctaacccgccttcgggttttgtggcctcctcatctggaatcttaccaggggcatcttcatcccagtcatctggcttgacagcttctggattgcacaccccgaatgacccaccgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctntgggtactcggcgtgtgcactcgtctgcacccatcagtctgaagaggttaaaattcaactccatattcagccctatgtttattccttctaaatgccctttttcccttccagataactgtcactaatagcact

SEQ ID NO: 305593 - DNA, 1018 bp, Homo sapiens
caacaggatgcagaaggcaatcactgccctggcacctagcaccatgaagatcaagatcattgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaacaaataaaagtgctgccgtaaccaaaaaaaaaaaaacaataaaccaaccaacgcactaagaacccataaaaacaaacatacacaaaaaaaaaacaaaagggggggggcccccaaaaattccccc

SEQ ID NO: 305594 - DNA, 797 bp, Homo sapiens
caacaggatgcagaaggcaatcactgccctggcacctagcaccatgaagatcaagatcattgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaaccacaaatatcaggatatttgtggttctggcttagataatatggctacacacttaagtcaacataaaactcatacttgccaagttgtaatgca

SEQ ID NO: 305595 - DNA, 643 bp, Homo sapiens
cggacacgagcaccgggagcgcgtcgccatgcactaccaggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaaaaaaaaaaacaaaccaaaccacacacaagaaacagaggg

SEQ ID NO: 305596 - DNA, 927 bp, Homo sapiens
caacaggatgcagaaggcaatcactgccctggcacctagcaccatgaagatcaagatcattgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaaaaaaaaaaacaaaccaaaccacacacaagaaacagaggg

SEQ ID NO: 305597 - DNA, 663 bp, Homo sapiens
  misc_feature (531)..(531): n is a, c, g, or t
caacaggatgcagaaggcaatcactgccctggcacctagcaccatgaagatcaagatcattgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctntgggtactcggcgtgtgcactcgtctgcacccatcagtctgaagaggttaaaattcaactccatattcagccctatgtttattccttctaaatgccctttttcccttccagataactgtcactaatagcact

SEQ ID NO: 305598 - DNA, 605 bp, Homo sapiens
  misc_feature (36)..(36): n is a, c, g, or t
gaggtgatctagaggatcccgtttacacaggctgtnttgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaaaaaaaaaaacaaaccaaaccacacacaagaaacagaggg

SEQ ID NO: 305599 - DNA, 675 bp, Homo sapiens
gcggtcgactactactactaaattcgcggccgcgtcgacgccaactccctgctcccagctgctttactaaaggggaagttcctgggcatctccgtgtttctctttgtggggctcaaaacctccaaggacctctctcaatgccattggttccttggaccgtatcactggtccacctcctgagcccctcaatcctatcacagtctactgacttttcccattcagctgtgagtgtccaaccctatcccagagaccttgatgcttggcctcccaatcttgccctaggatacccagatgccaaccagacacctccttcttcctagccaggctatctggcctgagacaacaaatgggtccctcagtctggcaatgggactctgagaactcctcattccctgactcttagccccagactcttcattcagtggcccacattttccttaggaaaaacatgagcatccccagccacaactgccagctctctgattccccaaatctgcatccttttcaaaacctaaaaacaaaaagaaaaacaaataaaacaaaaccaactcagaccagaactgttttctcaacctgggacttcctaaactttccaaaaccttcctcttccagcaactgaacctcgccataaggcacttatccctggttcctagcaccgcttatcccctcagaatc

SEQ ID NO: 305600 - DNA, 637 bp, Homo sapiens
cgcggtctaacacttttcgctcgcgcccctattttcgcagatttgtgtagcggatacaatctccccccgggaaacacctatgaccttgattccgccaagcctttaatacgacctacttatgggaaaagctgctccgcttgcaggtacgggtccgaattccgcggccgcctactactactaaattcgcggccgcgtcgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctagtcagagagtagtcctggaaggtggcctctgtgaggagccacggggacagcatcctgcagatggtcctggcccttgtcccaccgacctgtctacaaggactgtcctcgtggaccctcccctctgcacaggagctggaccctgaagtcccttccccaccggccaggactggagcccctacccctctgttggaatccctgcccaccttcttctggaagtcggctctggagacatttctctcttctttcagacctggacaggcagataacagatagcagttcccaggtcgaccggccgcgaat

SEQ ID NO: 305601 - DNA, 431 bp, Homo sapiens
gcggtcgactactactactaaattcgcggccgcgtcgacgtggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaagtttactacaatagggagttgataggggtgctcaggggttggccacgatggtatccttgatccacttccggtaatgcaccgtcgacgcggccgaaaatt

SEQ ID NO: 305602 - DNA, 1466 bp, Homo sapiens
cgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 305603 - DNA, 1728 bp, Homo sapiens
aagtttcccttctcccagtccaagaccccaaatcaccacaaaggacccaatccccagactcaagatatggtctgggcgctgtcttgtgtctcctaccctgatccctgggttcaactctgctcccagagcatgaagcctctccaccagcaccagccaccaacctgcaaacctagggaagattgacagaattcccagcctttcccagctccccctgcccatgtcccaggactcccagccttggttctctgcccccgtgtcttttcaaacccacatcctaaatccatctcctatccgagtcccccagttcctcctgtcaaccctgattcccctgatctagcaccccctctgcaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 305604 - DNA, 675 bp, Homo sapiens
  misc_feature (181)..(181): n is a, c, g, or t
agggattgaaggcttaaccaactttagctggggccaccacgcgaacgcgaatcctatatataaggtacccttgcttggccatgtagcccagtcggcgcgcttttatcaggccgggtggggcgggaagccctgtgaagagcagagagctggcggtactgccagcagcgaaccctcagaaganagcgcatgacatcagactgcttctttctccatagctcctggatgtacttgtatgcacccatcttggcttacctgatggctgccgcctcgtgccgaattcggcacgagggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 305605 - DNA, 509 bp, Homo sapiens
cgcggtctaacacttttcgctcgcgcccctattttcgcagatttgtgtagcggatacaatctccccccgggaaacacctatgaccttgattccgccaagcctttaatacgacctacttatgggaaaagctgctccgcttgcaggtacgggtccgaattccgcggccgcctactactactaaattcgcggccgcgtcgaccatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 305606 - DNA, 558 bp, Homo sapiens
tgcggtacagatatgcagagaacccattggttccttggaccgtatcactggtccacctcctgagcccctcaatcctatcacagtctactgacttttcccattcagctgtgagtgtccaaccctatcccagagaccttgatgcttggcctcccaatcttgccctaggatacccagatgccaaccagacacctccttcttcctagccaggctatctggcctgagacaacaaatgggtccctcagtctggcaatgggactctgagaactcctcattccctgactcttagccccagactcttcattcagtggcccacattttccttaggaaaaacatgagcatccccagccacaactgccagctctctgattccccaaatctgcatccttttcaaaacctaaaaacaaaaagaaaaacaaataaaacaaaaccaactcagaccagaactgttttctcaacctgggacttcctaaactttccaaaaccttcctcttccagcaactgaacctcgccataaggcacttatccctggttcctagcaccgcttatcccctcagaatc

SEQ ID NO: 305607 - DNA, 455 bp, Homo sapiens
acgcgctgcgaaggtgactctagcaggatctcaaaagcgtgatcttgctgggtcggcacagcctgtttcatcctgaagacacaggccaggtatttcaggtcagccacagcttcccacacccgctctacgatatgagcctcctgaagaatcgattcaagcaaggactgtgggaggtgggctttgtagtaacaagagggcagggtgaactctgattcccatgggggaatgtgatggtcctgttacaaatttttcaagctggcagggaataaaacccattacggtgaggacctgtggagggcggctgccccaactgataaaggaaatagccaggtgggggcctttcccattgtaggggggacatatctggcaatagaagcctttgagaccctttagggtacaagtactgaggcagcaaataaaatgaaatcttatttttcaactttatactgcatggg

SEQ ID NO: 305608 - DNA, 2639 bp, Homo sapiens
gagctcggtacccaaacgacccgaagaccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305609 - DNA, 2899 bp, Homo sapiens
aagtttcccttctcccagtccaagaccccaaatcaccacaaaggacccaatccccagactcaagatatggtctgggcgctgtcttgtgtctcctaccctgatccctgggttcaactctgctcccagagcatgaagcctctccaccagcaccagccaccaacctgcaaacctagggaagattgacagaattcccagcctttcccagctccccctgcccatgtcccaggactcccagccttggttctctgcccccgtgtcttttcaaacccacatcctaaatccatctcctatccgagtcccccagttcctcctgtcaaccctgattcccctgatctagcaccccctctgcaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305610 - DNA, 2205 bp, Homo sapiens
aacgggtgatgcggttgggggagatcccggggtgaagctgtggtgggggatccctcgggtgattcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305611 - DNA, 3081 bp, Homo sapiens
gagctcggtacccaaacgacccgaagaccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctagtcagagagtagtcctggaaggtggcctctgtgaggagccacggggacagcatcctgcagatggtcctggcccttgtcccaccgacctgtctacaaggactgtcctcgtggaccctcccctctgcacaggagctggaccctgaagtcccttccccaccggccaggactggagcccctacccctctgttggaatccctgcccaccttcttctggaagtcggctctggagacatttctctcttcttccaaagctgggaactgctatctgttatctgcctgtccaggtctgaaagataggattgcccaggcagaaactgggactgacctatctcactctctccctgcttttacccttagggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305612 - DNA, 2032 bp, Homo sapiens
gaaaggaccctggggagcgaagtggaggatacaaccttgggcctgcaggccaggctacctacccacttggaaacccacgccaaagccgcatctacagctgagccactctgaggcctcccctccccagcggtccccactcagctccaaagtctctctcccttttctctcccacactctatcatcccccggattcctctctacttggttctcattcttcctttgacttcctgcttccctttctcattcatctgtttctcactttctgcctggttttgttcttctctctctctttctctggcccatgtctgtttctctatgtttctgtcttttctttctcatcctgtgtattttcggctcaccttgtttgtcactgttctcccctctgccctttcattctctctgtccttttaccctcttcctttttcccttggtttctctcagtttctgtatctgcccttcaccctctcacactgctgtttcccaactcgttgtctgtatttttggcctgaactgtgtcttccccaaccctgtgtttttctcactgtttctttttctcttttggagcctcctccttgctcctctgtcccttctctctttccttatcatcctcgctcctcattcctgcgtctgcttcctccccagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca
